United States Patent
Hsu et al.

(10) Patent No.: US 11,104,745 B2
(45) Date of Patent: Aug. 31, 2021

(54) ANTI-TL1A/ANTI-TNF-ALPHA BISPECIFIC ANTIGEN BINDING PROTEINS AND USES THEREOF

(71) Applicant: AMGEN INC., Thousand Oaks, CA (US)

(72) Inventors: Hailing Hsu, Moorpark, CA (US); Gunasekaran Kannan, Daly City, CA (US); Kenneth W. Walker, Newbury Park, CA (US); Michelle Hortter, Camarillo, CA (US); Edward J. Belouski, Thousand Oaks, CA (US)

(73) Assignee: AMGEN INC., Thousand Oaks, CA (US)

( * ) Notice: Subject to any disclaimer, the term of this patent is extended or adjusted under 35 U.S.C. 154(b) by 232 days.

(21) Appl. No.: 16/062,096

(22) PCT Filed: Dec. 14, 2016

(86) PCT No.: PCT/US2016/066722
§ 371 (c)(1),
(2) Date: Jun. 13, 2018

(87) PCT Pub. No.: WO2017/106383
PCT Pub. Date: Jun. 22, 2017

(65) Prior Publication Data
US 2019/0119407 A1   Apr. 25, 2019

Related U.S. Application Data

(60) Provisional application No. 62/333,063, filed on May 6, 2016, provisional application No. 62/268,432, filed on Dec. 16, 2015.

(51) Int. Cl.
| | |
|---|---|
| *C07K 16/46* | (2006.01) |
| *C07K 16/24* | (2006.01) |
| *A61K 39/395* | (2006.01) |
| *C07K 16/28* | (2006.01) |
| *C12N 15/10* | (2006.01) |

(52) U.S. Cl.
CPC ........ *C07K 16/468* (2013.01); *A61K 39/3955* (2013.01); *C07K 16/241* (2013.01); *C07K 16/2875* (2013.01); *C07K 16/2878* (2013.01); *C07K 2317/21* (2013.01); *C07K 2317/31* (2013.01); *C07K 2317/55* (2013.01); *C07K 2317/622* (2013.01); *C07K 2317/66* (2013.01); *C07K 2317/76* (2013.01); *C07K 2317/90* (2013.01); *C07K 2319/00* (2013.01); *C12N 15/1058* (2013.01)

(58) Field of Classification Search
None
See application file for complete search history.

(56) References Cited

U.S. PATENT DOCUMENTS

| | | |
|---|---|---|
| 4,603,044 A | 7/1986 | Geho et al. |
| 5,830,877 A | 11/1998 | Carson et al. |
| 5,939,598 A | 8/1999 | Kucherlapati et al. |
| 6,114,598 A | 9/2000 | Kucherlapati et al. |
| 6,162,963 A | 12/2000 | Kucherlapati et al. |
| 6,521,422 B1 | 2/2003 | Hsu et al. |
| 6,833,268 B1 | 12/2004 | Green et al. |
| 7,049,426 B2 | 5/2006 | Green et al. |
| 7,064,244 B2 | 6/2006 | Jakobovits et al. |
| 7,285,269 B2 | 10/2007 | Babcook et al. |
| 7,820,798 B2 | 10/2010 | Yu et al. |
| 8,258,268 B2 | 9/2012 | Yu et al. |
| 8,263,743 B2 | 9/2012 | Smith et al. |
| 8,592,562 B2 | 11/2013 | Kannan et al. |
| 8,945,553 B2 | 2/2015 | Stevens et al. |
| 2008/0003221 A1 | 1/2008 | Podack |
| 2010/0322934 A1 | 12/2010 | Imhof-Jung et al. |

(Continued)

FOREIGN PATENT DOCUMENTS

| | | |
|---|---|---|
| JP | 04244018 A | 9/1992 |
| JP | 3202999 B2 | 8/2001 |

(Continued)

OTHER PUBLICATIONS

Liu, Zhi, et al., "A Novel Antibody Engineering Strategy for Making Monovalent Bispecific Heterodimeric IgG Antibodies by Electrostatic Steering Mechanism," *Journal of Biological Chemistry*, 290(12):7535-7562 (2015).
Allen, T. M. et al., "Pharmacokinetics of stealth versus conventional liposomes: effect of dose," Biochim. Biophys. Acta, 1068(2):133-141 (1991).
Allen, T. M. et al., "Subcutaneous administration of liposomes: a comparison with the intravenous and intraperitoneal routes of injection," *Biochim. Biophys. Acta (BBA)-Biomembranes*, 1150(1):9-16 (1993).

(Continued)

*Primary Examiner* — Bridget E Bunner
*Assistant Examiner* — Fozia M Hamud
(74) *Attorney, Agent, or Firm* — Timothy J. Gaul

(57) ABSTRACT

The present invention concerns antigen binding proteins that bind TL1A, including bispecific antigen binding proteins (e.g., antibodies) to TL1A and TNF-α. Such bispecific antibodies can be in a tetrameric immunoglobulin format, in which one heavy chain-light chain pair of the antibody is directed to TL1A and the other to TNF-α. The bispecific antigen binding proteins may also be comprised in an IgG-scFv fusion, in which a conventional tetrameric antibody directed to one antigen is fused to a pair of single chain Fv units directed to the other. The bispecific antigen binding protein may also be comprised in an IgG-Fab fusion, in which a Fab molecule that binds to one antigen is fused to each heavy chain of a conventional tetrameric antibody directed to the other antigen. The invention further relates to uses of the anti-TL1A binding proteins and anti-TL1A/anti-TNF-α antigen binding proteins, and pharmaceutical formulations thereof.

20 Claims, 38 Drawing Sheets

Specification includes a Sequence Listing.

(56) References Cited

U.S. PATENT DOCUMENTS

| | | |
|---|---|---|
| 2011/0076722 A1 | 3/2011 | Takahashi |
| 2011/0217310 A1 | 9/2011 | Siegel et al. |
| 2012/0114654 A1 | 5/2012 | Classon et al. |
| 2012/0195900 A1 | 8/2012 | Ghayur et al. |
| 2012/0263718 A1 | 10/2012 | Siegel et al. |
| 2014/0120109 A1 | 5/2014 | Classon et al. |
| 2014/0255302 A1 | 9/2014 | Poulton et al. |
| 2014/0308271 A1 | 10/2014 | Attinger et al. |
| 2015/0132311 A1 | 5/2015 | Arch et al. |
| 2016/0052006 A1 | 9/2016 | Kannan et al. |

FOREIGN PATENT DOCUMENTS

| | | |
|---|---|---|
| WO | 96/32478 A1 | 10/1996 |
| WO | 97/34631 A1 | 9/1997 |
| WO | 99/51259 A2 | 10/1999 |
| WO | 00/56772 A1 | 9/2000 |
| WO | 2005/018571 A2 | 3/2005 |
| WO | 2006/106905 A1 | 10/2006 |
| WO | 2009/089004 A1 | 7/2009 |
| WO | 2010/115553 A1 | 10/2010 |
| WO | 2012/088302 A2 | 6/2012 |
| WO | 2012/161856 A1 | 11/2012 |
| WO | 2013/041687 A1 | 3/2013 |
| WO | 2013/044298 A1 | 4/2013 |
| WO | 2014/081955 A1 | 5/2014 |
| WO | 2014/4082179 A1 | 6/2014 |
| WO | 2014/106602 A1 | 7/2014 |
| WO | 2014/137961 A1 | 9/2014 |
| WO | 2014/144357 A1 | 9/2014 |
| WO | 2014/144600 A2 | 9/2014 |
| WO | 2014/153111 A2 | 9/2014 |
| WO | 2014/159725 A1 | 10/2014 |
| WO | 2014/161845 A1 | 10/2014 |

OTHER PUBLICATIONS

Alving, C. R. et al., "Preparation and Use of Liposomes in Immunological Studies," G. Gregoriadis, PhD, ed., *Lipsome Technology*, 2$^{nd}$ Edition, vol. III, Interactions of Liposomes with the Biological Milieu, pp. 317-343, CRC Press (1993).

Anderson, P. et al., "Entrapment of Human Leukocyte Interferon in the Aqueous Interstices of Liposomes," *Infect. Immun.*, 31(3): 1099-1103 (1981).

Anderson, P. M. et al., Increased Local Antitumor Effects of Interleukin 2 Liposomes in Mice with MCA-106 Sarcoma Pulmonary Metastases, *Cancer Res.*, 50:1853-1856—(1990).

Arai, K. et al., "Cytokines: Coordinators of Immune and Inflammatory Responses," *Annu. Rev. Biochem.*, 59:783-836 (1990).

Bakker-Woudenberg, I. A. J. M. et al., "Lipsomes as carriers of antimicrobial agents or immunomodulatory agents in the treatment of infections," *Eur. J. Clin. Microbiol. Infect. Dis.*, 12(Suppl. 1):S61-S67 (1993).

Bartus, R. T. et al., Sustained delivery of proteins for novel therapeutic products, *Science*, 281(5380):1161-1162 (1998).

Bostrom, J. et al., "Variants of the Antibody Herceptin That Interact With Her2 and VEGF at the Antigen Binding Site," *Science*, 323(5921):1610-1614 (2009).

Bremer, U. et al., "Protein Delivery with Infusion Pumps," in Sanders, et al., eds., *Protein Delivery: Physical Systems*, Chapter 9, pp. 239-254, Plenum Press, NY (1997).

Buetler, B. A. et al., "The role of tumor necrosis factor in health and disease," *J. Rheumatol. Suppl.*, 57:16-21 (1999).

Byrne, H. et al., "A tale of two specificities: bispecific antibodies for therapeutic and diagnostic applications," *Trends in Biotechnology*, 31(11):621-631 (2013).

Cain, C., "Crossing over to bispecificity," Science-Business Exchange: SCIBX/From the Makers of Biocentury and Nature, Nature Publishing Group, USA, 4(28):1-3 (2011).

Claassen, E. et al., "The effect of elimination of macrophages on the tissue distribution of liposomes containing [$^3$H]methotrexate," *Biochim. Biophys. Acta*, 802(3):428-434 (1984).

Chames, P. and Baty, D., "Bispecific antibodies for cancer therapy," mAbs, 1(6):539-547 (2009) http://dx.doi.org/10.4161/mabs.1.6.10015.

Chothia, C. et al., "Canonical Structures for the Hypervariable Regions of Immunoglobulins," *J. Mol. Biol.*, 196:901-917 (1987).

Cohen, S. et al., "Lipid-alginate interactions render changes in phospholipid bilayer permeability," *Biochim. Biophys. Acta*, 1063(1):95-102 (1991).

Dalgleish, A. G. et al., "The Link Between Inflammation and Cancer, Wounds that do not heal," *Cancer Treat. Res.*, Chap. 1, pp. 1-38 (2006).

Davidson, A. et al., "Autoimmune Diseases," *New Engl. J. Med.*, 345(5):340-350 (2001).

Davis, J. H. et al., "SEEDbodies: fusion proteins based on strand-exchange engineered domain (SEED) $C_H3$ heterodimers in an Fc analogue platform for asymmetric binders or immunofusions and bispecific antibodies," *Protein Eng. Des. & Sel.*, 23(4):195-202 (2010).

DiBiase, M. D. et al., "Oral Delivery of Microencapsulated Proteins," *Protein Delivery: Physical Systems*, Sanders and Hendren, eds., pp. 255-288, Chapter 10, Plenum Press (1997).

DiGiammarino et al., "Design and Generation of DVD-Ig™ Molecules for Dual-Specific Targeting," *Methods Mol. Biol., Therapeutic Proteins, Methods and Protocols*, 2$^{nd}$ Ed., Chapter 9, Edited by Vladimir Voynov and Justin A. Caravella, Humana Press, 899:145-156 (2012).

D'Souza, W. N. et al., "Essential Role for IL-2 in the Regulation of Antiviral Extralymphoid CD8 T Cell Responses," *J Immunol*, 168:5566-5572 (2002).

Durocher, Y. et al., "High-level and high-throughput recombinant protein production by transient transfection of suspension-growing human 293-EBNA1 cells," *NRCC, Nucleic Acids Res.*, 30(2 e9):1-9 (2002).

Ellison, J. W. et al., "The nucleotide sequence of a human immunoglobulin $C\gamma_1$ gene," *Nucleic Acids Res.*, 10(13):4071-4079 (1982).

Fischer, N. and Leger, O., "Bispecific Antibodies: Molecules That Enable Novel Therapeutic Strategies," *Pathobiology*, 74:3-14 (2007).

Ford, C. F. et al., "Fusion tails for the recovery and purification of recombinant proteins," *Protein Expression and Purification*, 2(2):95-107 (1991).

Fransen, L. et al., "Molecular cloning of mouse tumor necrosis factor cDNA and its eukaryotic expression," *Nucleic Acids Res.*, 13(12):4417-4429 (1985).

Gennaro, ed., Remington's Pharmaceutical Sciences, Mack Publishing Co., Easton, PA (1990) (Table of Contents Only).

Gombotz, W. R. et al., "Biodegradable Polymers for Protein and Peptide Drug Delivery," *Bioconjugate Chem.*, 6(4):332-351 (1995).

Green, L. L. et al., "Antigen-specific human monoclonal antibodies from mice engineered with human Ig heavy and light chain YACs," *Nature Genetics*, 7:13-21 (1994).

Green and Jakobovitis, "Regulation of B Cell Development by Variable Gene Complexity in Mice Reconstituted with Human Immunoglobulin Yeast Artificial Chromosomes," *J. Exp. Med.*, 188:483-495 (1998).

Gref, R. et al., "Poly(ethylene glycol)-coated nanospheres: potential carriers for intravenous drug administration," *Pharm. Biotechnol.*, Chapter 6, 10:167-198 (1997).

Grussenmeyer, T. et al., "Complexes of polyoma virus medium T antigen and cellular proteins," *Proc. Natl. Acad. Sci. USA*, 82:7952-7954 (1985).

Gunasekaran et al., "Enhancing Antibody Fc Heterodimer Formation through Electrostatic Steering Effects," *J. Biol. Chem.*, 285(25):19637-19646 (2010).

Harasym, T. O. et al., "Clearance properties of liposomes involving conjugated proteins for targeting," *Adv. Drug Deliv. Rev.*, 32(1-2):99-118 (1998).

Hinchcliffe, M. et al., "Intranasal insulin delivery and therapy," *Adv. Drug Deliv. Rev.*, 35(2-3):199-234 (1999).

(56) References Cited

OTHER PUBLICATIONS

Hirano, A. et al., "Association study of 71 European Crohn's disease susceptibility loci in a Japanese population," *IBD*, 19(3):526-533 (2013).

Holliger, P. et al., "Diabodies: Small bivalent and bispecific antibody fragments," *Proc. Natl. Acad. Sci. USA*, 90:6444-6448 (1993).

Honegger, A. and Plückthun, A., "Yet another numbering scheme for immunoglobulin variable domains: an automatic modeling and analysis tool," *J. Mol. Biol.*, 309(3): 657-670 (2001).

Hopp. T. P. et al., "A Short Polypeptide Marker Sequence Useful for Recombinant Protein Identification and Purification." *Biotechnology*, 6:1204-1210 (1988).

Jalkanen, M. et al., "Heparan Sulfate Proteoglycans for Mouse Mammary Epithelial Cells: Localization on the Cell Surface with a Monoclonal Antibody," *J. Cell Biol.*, 101:976-984 (1985).

Jalkanen, M. et al., "Cell Surface Proteoglycan of Mouse Mammary Epithelial Cells is Shet by Cleavage of Its Matrix-Binding Ectodomain from its Membrane-Associated Domain," *J. Cell Biol.*, 105(6):3087-3096 (1987).

Kabat et al., "Complementarity Determining Region (CDR)", *Sequences of Proteins of Immunological Interest*, 5$^{th}$ Edition, Public Health Service, National Institutes of Health, Bethesda, MD (1991) (Table of Contents Only).

Kamps, J. A. A. M. et al., "Massive targeting of liposomes surface-modified with anionized albumins, to heptic endothelial cells," *Proc. Natl. Acad. Sci. USA*, 94:11681-11685 (1997).

Kato, Y. et al., "Modification of Liposomes by Addition of HCO60. I. Targeting of Liposomes to Liver by Addition of HCO60 to Lipsomes," *Biol. Pharm. Bull.*, 16(10):960-964 (1993).

Kato, Y. et al., "Targeted Delivery of Peptides, Proteins, and Genes by Receptor-Mediated Endocytosis," *Crit. Rev. Ther. Drug Carrier Syst.*, 14(3):287-331 (1997).

Kearney, J. F. et al., "A New Mouse Myeloma Cell Line That Has Lost Immunoglobulin Expression but Permits the Construction of Antibody-Secreting Hybrid Cell Lines," *J. Immunol.*, 123(4):1548-1550 (1979).

Kellerman, S-A and Green, L. L., "Antibody discovery: the use of transgenic mice to generate human monoclonal antibodies for therapeutics," *Current Opinion in Biotechnology*, 13:593-597 (2002).

Kim, S., "Liposomes as Carriers of Cancer Chemotherapy. Current Status and Future Prospects," *Drugs*, 46(4):618-638 (1993).

Kontermann, R. E., "Dual targeting strategies with bispecific antibodies," mAbs, 4(2):182-197 (2012) http://dx.doi.org/10.4161/mabs.4.2.19000.

Kostelny, S. A. et al., "Formation of a Bispecific Antibody by the Use of Leucine Zippers," *J. Immunol.*, 148(5):1547-1553 (1992).

Kriegler et al., "A novel form of TNF-α/cachectin is a cell surface cytotoxic transmembrane protein: ramifications for the complex physiology of TNF-α," *Cell*, 53(1):45-53 (1988).

Kufer, P. et al., "A revival of bispecific antibodies," *Trends in Biotechology*, 22(5):238-244 (2004).

Lemaigre, F. P. et al., "Transcriptional control of genes that regulate glycolysis and gluconeogenesis in adult liver," *Biochem. J.*, 303(Pt 1):1-14 (1994).

Lewis, Steven M., "Generation of bispecific IgG antibodies by structure-based design of a orthogonal Fab interface," Nature Biotechnology, 32(2):191-198 (2014).

Lindhofer, H. et al., Preferential species-restricted heavy/light chain pairing in rat/mouse quadromas. Implications for a single-step purification of bispecific antibodies., *J. Immunol.*, 155(1):219-225 (1995).

Loeken, M. R., "Effects of mutation of the CREB binding site of the somatostatin promoter on cyclic AMP responsiveness in CV-1 cells," *Gene Expr.*, 3(3):253-264 (1993).

Lu, H. et al., "Inflammation, a Key Event in Cancer Development," *Mol. Cancer Res.*, 4:221-233 (2006).

McGehee, R. E. et al., "Differentiation-specific element: a cis-acting developmental switch required for the sustained transcriptional expression of the angiotensinogen gene during hormonal-induced differentiation of 3$^T$3-L1 fibroblasts to adipocytes," *Mol. Endocrinol.*, 7(4):551-560 (1993).

Mendez, M. J. et al., "Functional transplant of megabase human immunoglobulin loci recapitulates human antibody response in mice," *Nature Genetics*, 15:146-156 (1997).

Mitrogotri, S. et al., "Ultrasound-mediated transdermal protein delivery," *Science*, 269(5225):850-853 (1995).

Mosmann, T. R., "Cytokines: is there biological meaning?," *Curr. Opin. Immunol.*, 3(3):311-314 (1991).

Müller, D. and Kontermann, R. E., Bispecific Antibodies for Cancer Immunotherapy, *Biodrugs*, 24(2):89-98 (2010).

Murahasi, N. et al., "Hepatic Acumulation of Glutamic Acid Branched Neogalactosyllipid Modified Liposomes," *Biol. Pharm. Bull.*, 20(3):259-266 (1997).

Nilsson, B. et al., "Immobilization and purification of enzymes with staphylococcal protein A gene fusion vectors," *EMBO J.*, 4(4):1075-1080 (1985).

Nilsson, B. et al., "Expression and purification of recombinant insulin-like growth factors from *Escherichia coli*," *Methods Enzymol.*, 198:3-16 (1991).

O'Reilly, M. A. et al., "Identification of an Activating Transcription Factor (ATF) Binding Site in the Human Transforming Growth Factor-β2 Promoter," *J. Biol. Chem.*, 267(28):19938-19943 (1992).

Paul, W. E. et al., "Lymphocyte responses and cytokines," *Cell*, 76(2):241-251 (1994).

Paul, MD, W. E., ed., "Evolution of the Immune System," *Fundamental Immunology*, Chapter 7, pp. 139-165, 2$^{nd}$ Edition, Raven Press, NY (1989).

Patton, J. S. et al., "Inhaled insulin," *Adv. Drug Deliv. Rev.*, 35(2-3):235-247 (1999).

Pettit, D. K. et al., "The development of site-specific drug-delivery systems for protein and peptide biopharmaceuticals," *TIBTECH*, 16(8):343-349 (1998).

Potts, R. O. et al., "Transdermal peptide delivery using electroporation," Chapter 8, , Springer-Verlag, *Pharm. Biotechnol.*, 10:213-238 (1997).

Putney, S. D. et al., Encapsulation of proteins for improved delivery, *Curr. Opin. Chem. Biol.* 2(4):548-552 (1998).

Putney, S. D. et al., "Improving protein therapeutics with sustained-release formulations," *Nature Biotechnology*, 16:153-157 (1998).

Ranade, V. V. et al., eds., "Site-Specific Drug Delivery Using Liposomes as Carriers," *Drug Delivery Systems*, 2nd Edition, Chapter 1, pp. 3-34, CRC Press (1995).

Ranade, V. V. et al., eds., "Implants in Drug Delivery," *Drug Delivery Systems*, 2nd Edition, Chapter 4, pp. 115-146, CRC Press (1995).

Ranade, V. V. et al., eds., "Role of Polymers in Drug Delivery," *Drug Delivery Systems*, 2nd Edition, Chapter 3, pp. 64-114, CRC Press (1995).

Richard, A. C. et al., "The TNF-family cytokine TL1A: from lymphocyte costimulatory to disease co-conspirator," *J. Leukoc. Biol.*, 98(3):333-345 (2015).

Ridgway, J. B. B. et al., "'Knobs-into-holes' engineering of antibody $CH_3$ domains for heavy chain heterodimerization," *Protein Eng.*, 9(7):617-621 (1996).

Roskos, K. V. et al., "Degradable Controlled Release Systems Useful for Protein Delivery," Sanders, L. M. and Hendren, R. W., eds., *Protein Delivery: Pharmaceutical Biotechnology*, Chapter 2, pp. 45-92, Plenum Press (1997).

Rossi, E. A. et al., "Novel Designs of Multivalent Anti-CD20 Humanized Antibodies as Improved Lymphoma Therapeutics," *Cancer Res.*, 68(20):8384-8392 (2008).

Rothmann et al., "Antibody-Dependent Cytotoxity Mediated by Natural Killer Cells is Enhanced by Castanospermine-Induced Alterations of IgG Glycosylation," *Mol. Immunol.*, 26(12):1113-1123 (1989).

Schaefer, W. et al., "Immunoglobulin domain crossover as a generic approach for the production of bispecific IgG antibodies," *Proc. Natl. Acad. Sci. USA*, 108(27): 11187-11192 (2011).

Scherphof, G. L. et al., "Uptake and intracellular processing of targeted and nontargeted liposomes by rat Kupffer cells in vivo and in vitro," *Ann. N.Y. Acad. Sci.*, 446:368-384 (1985).

(56) References Cited

OTHER PUBLICATIONS

Sethi, G. et al., "Targeting TNF for Treatment of Cancer and Autoimmunity," *Adv. Exp. Med. Biol.*, Chapter 3, 647:37-51 (2009).
Shields, R. L. et al., "Lack of Fucose on Human IgG1 N-Linked Oligosaccharide Improves Binding to Human FcγRIII and Antibody-dependent Cellular Toxicity," *J. Biol. Chem.*, 277(30):26733-26740 (2002).
Shimizu, K. et al., "Formulation of liposomes with a soybean-derived sterylglucoside mixture and cholesterol for liver targeting," *Biol. Pharm. Bull.*, 20(8):881-886 (1997).
Shinkawa, T. et al., "The Absence of Fucose but Not the Presence of Galactose or Bisecting N-Acetylglucosamine of Human IgG1 Complex-type Oligosaccharides Shows the Critical Role of Enhancing Antibody-dependent Cellular Cytotoxicity," *J. Biol. Chem.*, 278(5):3466-3473 (2003).
Smith, D. B. et al., Single-step purification of polypeptides expressed in *Escherichia coli* as fusions with glutathione S-transferase, *Gene*, 67(1):31-40 (1988).
Songsivilai, S. et al., "Bispecific antibody: a tool for diagnosis and treatment of disease," *Clin. Exp. Immunol.*, 79:315-321 (1990).
Speiss, C. et al., "Alternative molecular formats and therapeutic applications for bispecific antibodies," *Mol. Immunol.*, 67:95-106, http://dx.doi.org/10.1016/j.molimm.2015.01.003, (2015).
Tijssen, P. *Practice and Theory of Enzyme Immunoassays*, vol. 15, Eds. R. H. Burdon and P. H. van Knippenberg, Elsevier Amsterdam, (1993) (Table of Contents Only).
Umana, P. et al., "Engineered glycoforms of an antineuroblastoma IgG1 with optimized antibody-dependent cellular cytotoxic activity," *Nat. Biotechnol.*, 17(2):176-180 (1999).
Van Spriel, A. B. et al., Immunotherapeutic perspective for bispecific antibodies, *Immunology Today*, 21(8): 391-397 (2000).
Von Andrian, U. H. et al., "T-Cell Function and Migration—Two Sides of the Same Coin," *New Engl. J. Med.*, 343:1020-1034 (2000).
Wassef, N. M. et al., "Complement-dependent phagocytosis of liposomes by macrophages," *Meth. Enzymol.*, 149:124-134 (1987).
Wu, X. et al., "Fab-based bispecific antibody formats with robust biophysical properties and biological activity," mAbs Landes Bioscience, US, 7(3):470-482 (2015).
Wu, J. et al., "Increased liver uptake of liposomes and improved targeting efficacy by labeling with asialofetuin in rodents," *Hepatology*, 27:772-778 (1998).
Ye, J. et al., "Characterization of a silencer regulatory element in the human interferon-gamma promoter," *J. Biol. Chem.*, 269(41):25728-25734 (1994).
Yewey, G. L. et al., "Delivery of Proteins from a Controlled Release Injectable Implant," Sanders, L. M. et al., eds. *Protein Delivery: Pharmaceutical Biotechnology*, Chapter 3, pp. 93-117, Plenum Press (1997).
Yusuf-Makagiansar, H. et al., "Inhibition of LFA-1/ICAM-1 and VLA-4/VCAM-1 as a therapeutic approach to inflammation and autoimmune diseases," *Med. Res. Rev.*, 22(2):146-167 (2002).
Zola, H. "Using Monoclonal Antibodies: Soluble Antigens," *Monoclonal Antibodies: A Manual of Techniques*, Chapter 6, pp. 147-181, CRC Press, Inc. (1987).
Fischer, J. A. A. et al., "Combined inhibition of tumor necrosis factor α and interleukin-17 as therapeutic opportunity in rheumatoid arthritis: Development and characterization of a novel bispecific antibody," *Arthritis & Rheumatology*, 67(1): 51-62 (2015).

ANTI-TL1A/ANTI-TNF-ALPHA BISPECIFIC ANTIGEN BINDING PROTEINS AND USES THEREOF

CROSS-REFERENCE TO RELATED APPLICATIONS

This application claims the benefit of Application No. PCT/US2016/052006, filed Sep. 15, 2016, and U.S. Provisional Application Nos. 62/268,432, filed Dec. 16, 2015 and 62/333,063, filed May 6, 2016. Each of the foregoing applications is hereby incorporated by reference in its entirety.

FIELD OF THE INVENTION

This invention relates to biopharmaceuticals, particularly to therapeutic antigen binding proteins, methods of use thereof, pharmaceutical compositions thereof, and processes of making them. In particular, this invention relates to therapeutic antigen binding proteins that are capable of binding the cytokines TL1A and TNF-α.

BRIEF DESCRIPTION OF THE SEQUENCE LISTING

Incorporated herein by reference in its entirety is a Sequence Listing entitled, "A-1937-US-PCT-Repl_Seq_List 121818_ST25", comprising SEQ ID NO:1 through SEQ ID NO:2136, which includes nucleic acid and/or amino acid sequences disclosed herein. The Sequence Listing has been submitted herein in ASCII text format via EFS, and thus constitutes both the paper and computer readable form thereof. The Sequence Listing was first created using PatentIn on Nov. 22, 2016 and modified on Dec. 18, 2018, and is 3.45 MB in size.

BACKGROUND OF THE INVENTION

Cytokines are soluble, small proteins that mediate a variety of biological effects concerning the immune system. Such biological effects include induction of immune cell proliferation, development, differentiation, and/or migration; regulation of the growth and differentiation of many cell types; an inflammatory response through local or systemic accumulation of immune cells; and host-protective effects. See, for example, Arai et al., *Annu. Rev. Biochem.* 59:783 (1990); Mosmann, *Curr. Opin. Immunol.* 3:311 (1991); Paul et al., *Cell*, 76:241 (1994)). Such immune effects can produce pathological consequences when the effect leads to excessive and/or chronic inflammation, as in autoimmune disorders (such as multiple sclerosis) and cancer/neoplastic diseases. Oppenheim et al., eds., *Cytokine Reference*, Academic Press, San Diego, Calif. (2001); von Andrian et al., *New Engl. J. Med.*, 343:1020 (2000); Davidson et al., *New Engl. J. Med.*, 345:340 (2001); Lu et al., *Mol. Cancer Res.*, 4:221 (2006); Dalgleish et al., *Cancer Treat Res.*, 130:1 (2006).

TL1A (TNFSF15) is a cytokine, a TNF-α family member involved in T cell activation (Richard et al., *J Leukoc Biol.* 2015 September, 98(3):333-45). It is the ligand for Death Receptor 3 (DR3), also known as TNFRSF25. TL1A is mainly expressed at low basal level in monocytes, dendritic cells and endothelial cells, but highly induced after immune complex and cytokine and microbes stimulation. Multiple genome-wide association studies (GWAS) demonstrated TL1A single nucleotide polymorphisms (SNPs) associated with Crohn's disease in various ethnic populations. In addition, TL1A inflammatory bowel disease (IBD) risk SNPs were reported to be associated with Crohn's disease severity (Hirano, *IBD* 19: 526, 2013). In the preclinical studies, TL1A protein treatment exacerbated colitis development in the colitis prone mdr1a−/− mice, but not in the wild-type mice. Altogether, human genomic data and preclinical colitis model data demonstrate that TL1A plays an important role in IBD development, and its blockage will be beneficial for IBD treatment.

Tumor Necrosis Factor-α (TNF-α) is a cytokine involved in the regulation of various physiological and pathological process (Buetler, et al., *J Rheumatol Suppl.* 57: 16-21, 1999). It is implicated in tumor regression, septic shock, cachexia, and a number of inflammatory and autoimmune conditions. Fransen et al. (June 1985), "Molecular cloning of mouse tumor necrosis factor cDNA and its eukaryotic expression," *Nucleic Acids Res.* 13 (12): 4417-29; Kriegler et al. (April 1988), "A novel form of TNF-α/cachectin is a cell surface cytotoxic transmembrane protein: ramifications for the complex physiology of TNF-α," *Cell* 53 (1): 45-53. TNF-α inhibitors are a class of therapeutics approved to treat rheumatoid arthritis, psoriatic arthritis, juvenile idiopathic arthritis, ankylosing spondylitis, plaque psoriasis, Crohn's disease, and ulcerative colitis (Sethi et al., *Adv Exp Med Biol.* 2009; 647:37-51). TNF-α inhibitors include etanercept, adalimumab, certolizumab pegol, infliximab, and golimumab.

Approximately 50% of patients respond to treatment with TNF inhibitors. However, only approximately 40% of those patients maintain responses after one year of treatment. Therefore, there is strong need for therapeutics with large effect size with durable response. We hypothesize that targeting multiple inflammatory pathways, such as TNF and TL1A, will likely achieve larger effect size with anticipated safety profile.

SUMMARY OF THE INVENTION

This invention relates to the development of antigen binding proteins, particularly fully human antibodies that specifically bind TL1A. Preferred antigen binding proteins have strong binding affinity to both human and cynomolgus TL1A, and block TL1A mediated NF-kB activation and T cell activation. These antigen binding proteins have potential to be used as therapeutics for treatment of inflammatory bowel disease (IBD) and other autoimmune and inflammatory conditions.

The invention further relates to bispecific antigen binding proteins, particularly bispecific antibodies. Bispecific antigen binding proteins of the invention comprise a TL1A binding entity and a TNF-α binding entity. TL1A blocking proteins and TNF-α blocking proteins have different effects in studies measuring inhibition of induction of cytokines IFNγ, IL-5, IL-6, IL-8, and IL-10. TL1A but not TNF-α induces T cell activation in vivo. TL1A and TNF-α induce NF-κB in different cell types in human peripheral blood monocytes (PBMCs). TL1A and TNF-α further induce different cytokines in human PBMCs. TL1A and TNF-α induce some of the same genes but in different cell types (16 overlapping genes induced by TL1A in whole blood and TNF-α in NCM460 cells; 13 overlapping genes induced by TL1A in whole blood and TNF-α in PBMCs). There is a strong genetic association of TL1A with inflammatory bowel disease (IBD) and anti-TNF agents are clinically validated for treatment of IBD. Such bispecific antigen binding proteins thus are useful for treatment of IBD and other autoimmune and inflammatory conditions. For these and other reasons, there is a benefit to bispecific antigen binding proteins that specifically bind TL1A and TNF-α.

One format for such bispecific antigen binding proteins is heterodimeric immunoglobulins (hetero Ig). Such hetero Ig antigen binding proteins have one heavy chain-light chain pair directed to TL1A and another directed to TNF-α.

Another format for such bispecific antigen binding proteins is IgG-scFv molecules. In an IgG-scFv, each heavy chain of an antibody that specifically binds one target is linked to a single chain antibody (scFv) that specifically binds the other target. The scFv portion can be linked to the heavy chain of the IgG portion directly or through a peptide linker. In the IgG-scFv format, the IgG is directed to TL1A and the scFv portion to TNF-α or vice-versa. Bispecific antigen binding proteins in the IgG-scFv format have the advantage of being bivalent for both of their target antigens.

A further format for such bispecific antigen binding proteins is IgG-Fab molecules. In this format, the antigen binding protein has a structure such that a Fab molecule that binds to one target is fused to each heavy chain of an IgG molecule that binds to another target. One chain of a Fab portion can be linked directly or through a peptide linker to the C-terminus of a heavy chain of the IgG portion. The resulting molecule has the advantage of being tetravalent and bispecific. All variations of the IgG-Fab format preferably comprise the CDR sequences of Tables 21.2A and 21.2B hereinafter. Preferred heavy and light chain sequences of IgG-Fab molecules appear in Table 21.1 hereinafter.

Other formats for bispecific antigen binding proteins are within the scope of this invention. One such format is IgG-Fab molecules. In this format, each heavy chain of an antibody that specifically binds to one target is linked to a Fab fragment that specifically binds to the other target. In the IgG-Fab format, the IgG is directed to TL1A and the Fab portion to TNF-α or vice-versa. Bispecific antigen binding proteins in the IgG-Fab format have the advantage of being bivalent for both of their target antigens. Other formats for bispecific antigen binding proteins within the scope of this invention are described infra.

The invention also relates to isolated nucleic acids encoding the TL1A-specific antigen binding proteins of the invention, as well as vectors comprising the nucleic acids, host cells comprising the vectors, and methods of making and using the TL1A-specific antigen binding proteins.

The invention also relates to isolated nucleic acids encoding the bispecific antigen binding proteins of the invention, as well as vectors comprising the nucleic acids, host cells comprising the vectors, and methods of making and using the bispecific antigen binding proteins.

In other embodiments, the present invention provides compositions comprising the TL1A-specific antigen binding proteins, the bispecific antigen binding proteins and kits comprising the anti-TL1A or bispecific antigen binding proteins, as well as articles of manufacture comprising the anti-TL1A or bispecific antigen binding proteins.

The TL1A-specific antigen binding proteins and the bispecific antigen binding proteins described herein can be used in the manufacture of pharmaceutical compositions or medicaments for the treatment of conditions associated with TL1A and/or, in the case of bispecific antigen binding proteins, conditions associated with TNF-α. Thus, the present invention also provides pharmaceutical compositions comprising a TL1A-specific antigen binding protein or a bispecific antigen binding protein and a pharmaceutically acceptable diluent, excipient or carrier.

The invention further relates to methods of treatment using the TL1A-specific antigen binding proteins. The TL1A-specific antigen binding proteins of the present invention are useful for the inhibition of the proinflammatory cytokine TL1A. The antibodies can be used to reduce, limit, neutralize, or block the proinflammatory effects of TL1A. Thus, in some embodiments, the invention relates to the treatment of IBD and other autoimmune or inflammatory conditions using the TL1A-specific antigen binding proteins.

The invention further relates to methods of treatment using bispecific antigen binding proteins. The bispecific antigen binding proteins of the present invention are useful for the inhibition of the proinflammatory cytokines, TL1A and TNF-α. The bispecific binding proteins can be used to reduce, limit, neutralize, or block the proinflammatory effects of TL1A. Likewise, the bispecific antigen binding proteins hereof can be used to reduce, limit, neutralize, or block the proinflammatory effects of TNF-α. Thus, in some embodiments, the invention relates to the treatment of IBD and other autoimmune or inflammatory conditions using TL1A-specific/TNF-specific antigen binding proteins.

BRIEF DESCRIPTION OF THE DRAWINGS

FIG. 1 shows a preferred embodiment, in which the heavy and light chains comprise charge mutations to aid in correct association of the heavy and light chains. The Kabat-Eu numbering scheme is used to denote the positions of charge pair mutations within each of the chains and for all sequences throughout this specification. This IgG-like bispecific antigen binding protein format is a heterotetramer comprising two different light chains and two different heavy chains. HC1 and LC1 refer to the heavy chain and light chain, respectively, of one Fab binding arm and HC2 and LC2 refers to the heavy chain and light chain, respectively, of the second Fab binding arm. For example, in the schematic, HC1 and LC1 correspond to the anti-TL1A receptor binding arm and HC2 and LC2 correspond to the anti-TNF-α binding arm. However, the two binding arms can be switched such that HC1 and LC1 correspond to the anti-TNF-α binding arm and HC2 and LC2 correspond to the anti-TL1A receptor binding arm.

FIG. 8 shows mass analysis of 20 μg non-reduced anti-TL1A/anti-TNF-α hetero-Ig eluted from a reverse-phase HPLC gradient using an Agilent Zorbax 300SB-C8 column (2.1×50 mm 3.5 μm) and mobile phases of 0.1% TFA and 90% n-Propanol/0.1% TFA (mobile phases A and B, respectively), equipped with an Agilent 6230 ESI-TOF Mass Spectrometer.

DETAILED DESCRIPTION OF THE INVENTION

Definition of Terms

Figure 1:
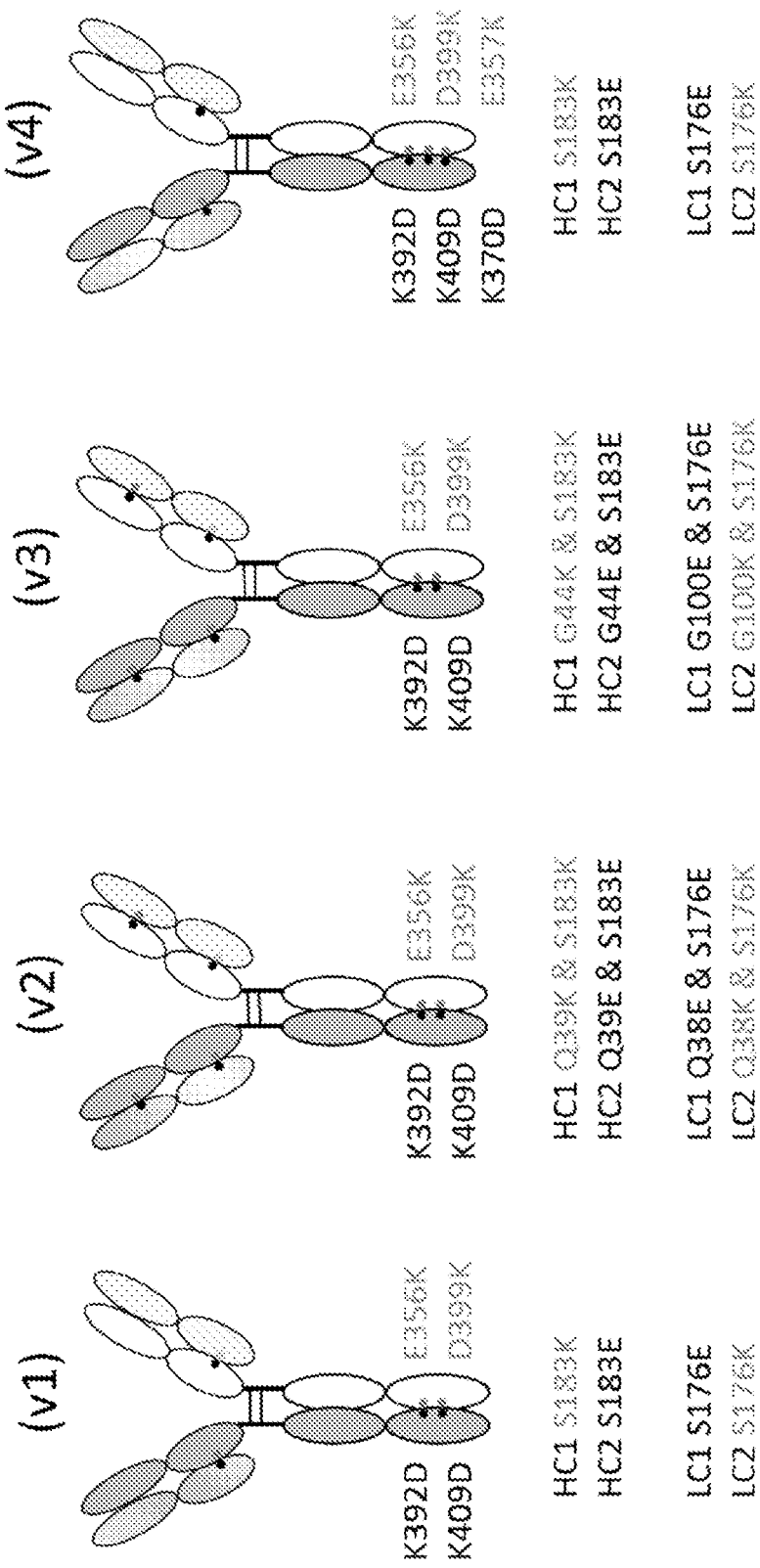
FIG. 1 shows a schematic representation of four bispecific hetero Ig formats used to generate anti-TL1A/anti-TNF-α bispecific antigen binding proteins. As shown, a heavy chain directed to one antigen is disulfide-bonded to a heavy chain directed to a different antigen. A light chain for each antigen is disulfide-bonded to the heavy chain for the corresponding antigen.

In the description that follows, a number of terms are used extensively. The following definitions are provided to facilitate understanding of the invention.

Unless otherwise specified, "a", "an", "the", and "at least one" are used interchangeably and mean one or more than one.

A "binding entity" as used herein means any monomeric or multimeric protein or protein fragment that specifically binds a specified target antigen. The term "binding entity" includes but is not limited to antibodies and binding parts thereof, such as immunologically functional fragments. Peptibodies and peptides are other examples of binding entities. The term "immunologically functional fragment" (or simply "fragment") of an antibody or immunoglobulin chain (heavy or light chain) binding entity, as used herein, is a species of binding entity comprising a portion (regardless of how that portion is obtained or synthesized) of an antibody that lacks at least some of the amino acids present in a full-length chain but which is still capable of specifically binding to an antigen. Such fragments are biologically active in that they bind to the target antigen and can compete with other binding entities, including intact antibodies, for binding to a given epitope. In some embodiments, the fragments are neutralizing fragments. In some embodiments, the fragments can block or reduce the likelihood of the interaction between the target antigen (TL1A or TNF-α) and its receptor. In one aspect, such a fragment will retain at least one CDR present in the full-length light or heavy chain, and in some embodiments will comprise a single heavy chain and/or light chain or portion thereof. These biologically active fragments can be produced by recombinant DNA techniques, or can be produced by enzymatic or chemical cleavage of binding entities, including intact antibodies. Immunologically functional immunoglobulin fragments include, but are not limited to, Fab, a diabody (heavy chain variable domain on the same polypeptide as a light chain variable domain, connected via a short peptide linker that is too short to permit pairing between the two domains on the same chain), Fab', F(ab')$_2$, Fv, domain antibodies and single-chain antibodies, and can be derived from any mammalian source, including but not limited to human, mouse, rat, camelid or rabbit. It is further contemplated that a functional portion of the binding entities disclosed herein, for example, one or more CDRs, could be covalently bound to a second protein or to a small molecule to create a therapeutic agent directed to a particular target in the body, possessing bifunctional therapeutic properties, or having a prolonged serum half-life. As will be appreciated by one of skill in the art, a binding entity can include non-protein components. In some sections of the present disclosure, examples of binding entities are named herein in terms of "number/letter/number" (e.g., 23B3), with some binding entities further identified by additional letter/number combinations (e.g., VH4). In these cases, the exact name denotes a specific antibody. That is, a binding entity named 23B3 may have some degree of sequence identity with but is not the same as an antibody named 23B3 VH4 (unless they are explicitly taught to be the same in the specification).

A "TL1A binding entity" is a binding entity that specifically binds to human TL1A; i.e., a binding entity for which human TL1A is the target antigen.

A "TNF-α binding entity" is a binding entity that specifically binds to human TNF-α; i.e., a binding entity for which human TNF-α is the target antigen.

"Antigen binding protein" refers to a protein or polypeptide that comprises an antigen-binding region or antigen-binding portion that has a strong affinity for another molecule to which it binds (antigen). Antigen-binding proteins encompass antibodies, peptibodies, antibody fragments, antibody derivatives, antibody analogs, fusion proteins, and antigen receptors including chimeric antigen receptors (CARs).

"Antibodies" (Abs) and "immunoglobulins" (Igs) are glycoproteins having the same structural characteristics. While antibodies exhibit binding specificity to a specific antigen, immunoglobulins include both antibodies and other antibody-like molecules that lack antigen specificity. Polypeptides of the latter kind are, for example, produced at low levels by the lymph system and at increased levels by myelomas. Thus, as used herein, the term "antibody" or "antibody peptide(s)" refers to an intact antibody, an antibody that competes for specific binding with an antibody disclosed in this specification, or an antigen-binding fragment thereof that competes with the intact antibody for specific binding and includes chimeric, humanized, fully human, and bispecific antibodies. In certain embodiments, antigen-binding fragments are produced, for example, by recombinant DNA techniques. In additional embodiments, antigen-binding fragments are produced by enzymatic or chemical cleavage of intact antibodies. Antigen-binding fragments include, but are not limited to, Fab, Fab', F(ab)$^2$, F(ab')$^2$, Fv, and single-chain antibodies.

The term "isolated antibody" as used herein refers to an antibody that has been identified and separated and/or recovered from a component of its natural environment. Contaminant components of its natural environment are materials which would interfere with diagnostic or therapeutic uses for the antibody, and may include enzymes, hormones, and other proteinaceous or nonproteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain. Isolated antibody includes the antibody in situ within recombinant cells since at least one component of the antibody's natural environment will not be present. Ordinarily, however, isolated antibody will be prepared by at least one purification step.

The term "agonist" refers to any compound including a protein, polypeptide, peptide, antibody, antibody fragment, large molecule, or small molecule (less than 10 kD), that increases the activity, activation or function of another molecule.

The term "antagonist" refers to any compound including a protein, polypeptide, peptide, antibody, antibody fragment, large molecule, or small molecule (less than 10 kD), that decreases the activity, activation or function of another molecule.

The term "bind(ing)" of an antigen or other polypeptide includes, but is not limited to, the binding of a ligand polypeptide of the present invention to a receptor; the binding of a receptor polypeptide of the present invention to a ligand; the binding of an antibody of the present invention to an antigen or epitope; the binding of an antigen or epitope of the present invention to an antibody; the binding of an antibody of the present invention to an anti-idiotypic antibody; the binding of an anti-idiotypic antibody of the present invention to a ligand; the binding of an anti-idiotypic antibody of the present invention to a receptor; the binding of an anti-anti-idiotypic antibody of the present invention to a ligand, receptor or antibody, etc.

Figure 2:
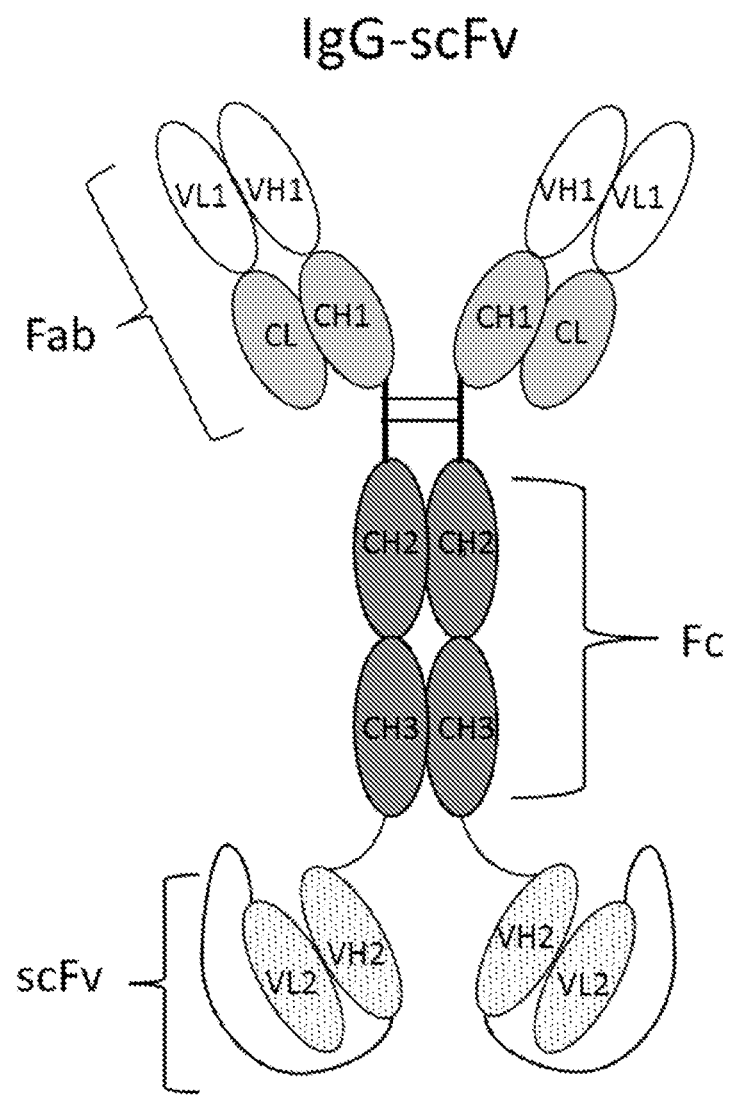
FIG. 2 shows a schematic representation of the IgG-scFv format used to generate anti-TL1A/anti-TNF-α bispecific antigen binding proteins. As shown, the structure incorporates a full tetrameric IgG directed to one antigen. A single-chain variable fragment (scFv), which comprises variable domains from a second antibody linked together by a glycine-serine linker, is fused to the carboxyl terminus of the heavy chain of a first antibody through a peptide linker to produce a modified heavy chain. Although the VH-VL orientation of the variable domains within the scFv is shown, the variable domains may also be organized in a VL-VH orientation. The complete molecule is a multimer comprising two heavy chains (but one unique heavy chain sequence) and two light chains (but one unique light chain sequence) from the first antibody.

A "bispecific" antigen binding protein is a molecule with binding entities derived from both a first antigen binding protein (e.g., antibody) that specifically binds a first target molecule of interest and a second antigen binding protein (e.g., antibody) that specifically binds a second target molecule of interest. Bispecific antigen binding proteins may be produced by a variety of methods including, but not limited to, fusion of hybridomas or linking of Fab' fragments. See, e.g., Songsivilai et al., Clin. Exp. Immunol., 79:315-321 (1990); Kostelny et al., J. Immunol., 148:1547-1553 (1992), hereby incorporated by reference. Molecules in the formats depicted in FIGS. 1 and 2 are bispecific antigen binding proteins in accordance with this definition. Various additional formats of bispecific antigen binding proteins within this definition are disclosed in WO 2014/159725; WO 2013/041687; U.S. Pat. Nos. 8,945,553; 8,945,553; 8,258,268; US Pat. App. No. 2012/0195900; International patent application WO 2012/088302; U.S. Prov. App. 62/218,977; Fischer and Leger (2007), *Pathobiology* 74:3-14; van Spriel et al. (2000), *Immunology Today* 21(8): 391-7; Kufer et al. (2004), *Trends in Biotechnology* 22(5): 238-44; Byrne et al. (2013), *Trends in Biotechnology* 31(11): 621-31; Muller and Kontermann (2010), *Biodrugs* 24(2): 89-98; Chames and Baty (2009), http://dx.doi.org/10.4161/mabs.1.6.10015; Kontermann (2012), http://dx.doi.org/10.4161/mabs.4.2.19000; Holliger et al. (1993), *Proc. Natl. Acad. Sci. USA* 90: 6444-8; Speiss et al., *Mol. Immunol.* (2015), 67: 95-106, http://dx.doi.org/10.1016/j.molimm.2015.01.003; Holliger et al. (1993), *Proc. Natl. Acad. Sci. USA* 90: 6444-8; Speiss et al., *Mol. Immunol.* (2015), http://dx.doi.org/10.1016/j.molimm.2015.01.003; Ridgway et al, (1996), *Protein Eng.* 9: 617; Gunasekaran et al (2010), *J. Biol. Chem.* 285:19637; Davis (2010), *Protein Eng. Des. & Sel.* 23:195; DiGiammarino et al. (2012), *Methods Mol. Biol.* 899:145, 2012); Lindhofer et al. (1995), *J. Immunol.* 155: 219: Schaefer et al. (2011), *Proc. Natl. Acad. Sci. USA*, 108: 11187; Regula et al, US Patent Application No: 2010/0322934; Bostrom et al. (2009), *Science* 323:1610; US Pat. App. 2011/0076722; Rossi et al. (2008), *Cancer Res.* 68:8384; each of which is hereby incorporated by reference.

The term "epitope" refers to the portion of an antigen to which an antibody specifically binds. Thus, the term "epitope" includes any protein determinant capable of specific binding to an immunoglobulin or T-cell receptor. Epitopic determinants usually consist of chemically active surface groupings of molecules such as amino acids or sugar side chains and usually have specific three dimensional structural characteristics, as well as specific charge characteristics. More specifically, the term "IL-17 epitope", "TNF-α epitope" and/or "TNF-α/p19 epitope" as used herein refers to a portion of the corresponding polypeptide having antigenic or immunogenic activity in an animal, preferably in a mammal, and most preferably in a mouse or a human. An epitope having immunogenic activity is a portion of, for example, an IL-17A or IL-17F or TNF-α/p19 polypeptide that elicits an antibody response in an animal. An epitope having antigenic activity is a portion of, for example, an IL-17A or IL-17F or TNF-α/p19 polypeptide to which an antibody immunospecifically binds as determined by any method well known in the art, for example, by immunoassays, protease digest, crystallography or HID-Exchange. Antigenic epitopes need not necessarily be immunogenic. Such epitopes can be linear in nature or can be a discontinuous epitope. Thus, as used herein, the term "conformational epitope" refers to a discontinuous epitope formed by a spatial relationship between amino acids of an antigen other than an unbroken series of amino acids.

The term "immunoglobulin" refers to a protein consisting of one or more polypeptides substantially encoded by immunoglobulin genes. One form of immunoglobulin constitutes the basic structural unit of an antibody. This form is a tetramer and consists of two identical pairs of immunoglobulin chains, each pair having one light and one heavy chain. In each pair, the light and heavy chain variable regions are together responsible for binding to an antigen, and the constant regions are responsible for the antibody effector functions.

Full-length immunoglobulin "light chains" (about 25 Kd or about 214 amino acids) are encoded by a variable region gene at the NH2-terminus (about 110 amino acids) and a kappa or lambda constant region gene at the COOH-terminus. Full-length immunoglobulin "heavy chains" (about 50 Kd or about 446 amino acids), are similarly encoded by a variable region gene (about 116 amino acids) and one of the other aforementioned constant region genes (about 330 amino acids). Heavy chains are classified as gamma, mu, alpha, delta, or epsilon, and define the antibody's isotype as IgG (such as IgG1, IgG2, IgG3 and IgG4), IgM, IgA, IgD and IgE, respectively. Within light and heavy chains, the variable and constant regions are joined by a "J" region of about 12 or more amino acids, with the heavy chain also including a "D" region of about 10 more amino acids. (See generally, Fundamental Immunology (Paul, W., ed., 2nd Edition, Raven Press, NY (1989)), Chapter 7 (incorporated by reference in its entirety for all purposes).

An immunoglobulin light or heavy chain variable region consists of a "framework" region interrupted by three hypervariable regions. Thus, the term "hypervariable region" refers to the amino acid residues of an antibody which are responsible for antigen binding. The hypervariable region comprises amino acid residues from a "Complementarity Determining Region" or "CDR" (Kabat et al., Sequences of Proteins of Immunological Interest, 5th Edition, Public Health Service, National Institutes of Health, Bethesda, Md. (1991)) and/or those residues from a "hypervariable loop" (Chothia et al., J. Mol. Biol. 196: 901-917 (1987)) (both of which are incorporated herein by reference). "Framework Region" or "FR" residues are those variable domain residues other than the hypervariable region residues as herein defined. The sequences of the framework regions of different light or heavy chains are relatively conserved within a species. Thus, a "human framework region" is a framework region that is substantially identical (about 85% or more, usually 90-95% or more) to the framework region of a naturally occurring human immunoglobulin. The framework region of an antibody, that is the combined framework regions of the constituent light and heavy chains, serves to position and align the CDR's. The CDR's are primarily responsible for binding to an epitope of an antigen. Accordingly, the term "humanized" immunoglobulin refers to an immunoglobulin comprising a human framework region and one or more CDR's from a non-human (usually a mouse or rat) immunoglobulin. The non-human immunoglobulin providing the CDR's is called the "donor" and the human immunoglobulin providing the framework is called the "acceptor". Constant regions need not be present, but if they are, they must be substantially identical to human immunoglobulin constant regions, i.e., at least about 85-90%, preferably about 95% or more identical. Hence, all parts of a humanized immunoglobulin, except possibly the CDR's, are substantially identical to corresponding parts of natural human immunoglobulin sequences. Further, one or more residues in the human framework region may be back mutated to the parental sequence to retain optimal antigen-binding affinity and specificity. In this way, certain framework residues from the non-human parent antibody are retained in the humanized antibody in order to retain the binding properties of the parent antibody while minimizing its immunogenicity. The term "human framework region" as used herein includes regions with such back mutations. A "humanized antibody" is an antibody comprising a humanized light chain and a humanized heavy chain immunoglobulin. For example, a humanized antibody would not encompass a typical chimeric antibody as defined above, e.g., because the entire variable region of a chimeric antibody is non-human.

As used herein, the term "modified heavy chain" refers to a fusion protein comprising an immunoglobulin heavy chain, particularly a human IgG1 or human IgG2 heavy chain, and a functional antibody fragment (e.g., a Fab or scFv) or portion thereof (e.g. immunoglobulin light chain or Fd fragment), wherein the fragment or portion thereof is fused at its N-terminus, optionally through a peptide linker, to the C-terminus of the heavy chain.

The term "humanized" immunoglobulin refers to an immunoglobulin comprising a human framework region and one or more CDR's from a non-human, e.g., mouse, rat or rabbit, immunoglobulin. The non-human immunoglobulin providing the CDR's is called the "donor" and the human immunoglobulin providing the framework is called the "acceptor". Constant regions need not be present, but if they are, they must be substantially identical to human immunoglobulin constant regions, i.e., at least about 85-90%, preferably about 95% or more identical. Hence, all parts of a humanized immunoglobulin, except possibly the CDR's and possibly a few back-mutated amino acid residues in the framework region (e.g., 1-15 residues), are substantially identical to corresponding parts of natural human immunoglobulin sequences. A "humanized antibody" is an antibody comprising a humanized light chain and a humanized heavy chain immunoglobulin. For example, a humanized antibody would not encompass a typical chimeric antibody as defined above, e.g., because the entire variable region of a chimeric antibody is non-human.

The terms "human antibody" and "fully human antibody" each refer to an antibody that has an amino acid sequence of a human immunoglobulin, including antibodies isolated from human immunoglobulin libraries or from animals transgenic for one or more human immunoglobulins and that do not express endogenous immunoglobulins; for example, Xenomouse antibodies and antibodies as described by Kucherlapati et al. in U.S. Pat. No. 5,939,598.

The term "genetically altered antibodies" means antibodies wherein the amino acid sequence has been varied from that of a native antibody. Because of the relevance of recombinant DNA techniques in the generation of antibodies, one need not be confined to the sequences of amino acids found in natural antibodies; antibodies can be redesigned to obtain desired characteristics. The possible variations are many and range from changing just one or a few amino acids to complete redesign of, for example, the variable and/or constant region. Changes in the constant region will, in general, be made in order to improve or alter characteristics, such as complement fixation, interaction with membranes and other effector functions. Changes in the variable region will be made in order to improve the antigen binding characteristics.

A "Fab fragment" is comprised of one light chain and the $C_{H1}$ and variable regions of one heavy chain. The heavy chain of a Fab molecule cannot form a disulfide bond with another heavy chain molecule.

A "Fab' fragment" contains one light chain and one heavy chain that contains more of the constant region, between the $C_{H1}$ and $C_{H2}$ domains, such that an interchain disulfide bond can be formed between two heavy chains to form a $F(ab')_2$ molecule.

A "$F(ab')_2$ fragment" contains two light chains and two heavy chains containing a portion of the constant region between the $C_{H1}$ and $C_{H2}$ domains, such that an interchain disulfide bond is formed between two heavy chains.

The term "native Fc" refers to molecule or sequence comprising the sequence of a non-antigen-binding fragment resulting from digestion of whole antibody, whether in monomeric or multimeric form. The original immunoglobulin source of the native Fc is preferably of human origin and may be any of the immunoglobulins, although IgG1, IgG2 and IgG4 are preferred. Native Fc's are made up of monomeric polypeptides that may be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, IgE) or subclass (e.g., IgG1, IgG2, IgG3, IgG4, IgA1, IgGA2). One example of a native Fc is a disulfide-bonded dimer resulting from papain digestion of an IgG (see Ellison et al. (1982), *Nucleic Acids Res.* 10: 4071-9). The term "native Fc" as used herein is generic to the monomeric, dimeric, and multimeric forms.

The term "Fc variant" refers to a molecule or sequence that is modified from a native Fc but still comprises a binding site for the salvage receptor, FcRn. International applications WO 97/34631 (published 25 Sep. 1997) and WO 96/32478 describe exemplary Fc variants, as well as interaction with the salvage receptor, and are hereby incorporated by reference. Thus, the term "Fc variant" comprises a molecule or sequence that is humanized from a non-human native Fc. Furthermore, a native Fc comprises sites that may be removed because they provide structural features or biological activity that are not required for the fusion molecules of the present invention. Thus, the term "Fc variant" comprises a molecule or sequence that lacks one or more native Fc sites or residues that affect or are involved in (1) disulfide bond formation, (2) incompatibility with a selected host cell (3)N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC). Fc variants are described in further detail hereinafter.

The term "Fc domain" encompasses native Fc and Fc variant molecules and sequences as defined above. As with Fc variants and native Fc's, the term "Fc domain" includes molecules in monomeric or multimeric form, whether digested from whole antibody or produced by other means.

The term "multimer" as applied to Fc domains or molecules comprising Fc domains refers to molecules having two or more polypeptide chains associated covalently, non-covalently, or by both covalent and non-covalent interactions. IgG molecules typically form dimers; IgM, pentamers; IgD, dimers; and IgA, monomers, dimers, trimers, or tetramers. Multimers may be formed by exploiting the sequence and resulting activity of the native Ig source of the Fc or by derivatizing (as defined below) such a native Fc.

The term "dimer" as applied to Fc domains or molecules comprising Fc domains refers to molecules having two polypeptide chains associated covalently or non-covalently. Thus, exemplary dimers within the scope of this invention are as shown in FIG. 2.

The terms "Fv fragment" and "single chain antibody" refer to polypeptides containing antibody variable regions from both heavy and light chains but lacking constant regions. Like a whole antibody, it is able to bind selectively to a specific antigen. With a molecular weight of only about 25 kDa, Fv fragments are much smaller than common antibodies (150-160 kD) which are composed of two heavy protein chains and two light chains, and even smaller than Fab fragments (about 50 kDa, one light chain and half a heavy chain).

A "single domain antibody" is an antibody fragment consisting of a single domain Fv unit, e.g., $V_H$ or $V_L$. Like a whole antibody, it is able to bind selectively to a specific antigen. With a molecular weight of only 12-15 kDa, single-domain antibodies are much smaller than common antibodies (150-160 kDa) which are composed of two heavy protein chains and two light chains, and even smaller than Fab fragments (.about.50 kDa, one light chain and half a heavy chain) and single-chain variable fragments (.about.25 kDa, two variable domains, one from a light and one from a heavy chain). The first single-domain antibodies were engineered from heavy-chain antibodies found in camelids. Although most research into single-domain antibodies is currently based on heavy chain variable domains, light chain variable domains and nanobodies derived from light chains have also been shown to bind specifically to target epitopes.

The term "monoclonal antibody" as used herein is not limited to antibodies produced through hybridoma technology. The term "monoclonal antibody" refers to an antibody that is derived from a single clone, including any eukaryotic, prokaryotic, or phage clone, and not the method by which it is produced.

In some embodiments, the anti-TL1A antigen binding protein, bispecific antigen binding protein or functional fragment of either thereof from which the anti-TL1A binding domain is derived selectively inhibits human TL1A relative to TNF superfamily ligands. An antibody or functional fragment thereof "selectively inhibits" a specific receptor or ligand relative to other receptors or ligands when the IC50 of the antibody in an inhibition assay of the specific receptor is at least 50-fold lower than the IC50 in an inhibition assay of another "reference" ligand or receptor. An "IC50" is the dose/concentration required to achieve 50% inhibition of a biological or biochemical function. With radioactive ligands, IC50 is the concentration of a competing ligand that displaces 50% of the specific binding of the radioactive ligand. The IC50 of any particular substance or antagonist can be determined by constructing a dose-response curve and examining the effect of different concentrations of the drug or antagonist on reversing agonist activity in a particular functional assay. IC50 values can be calculated for a given antagonist or drug by determining the concentration needed to inhibit half of the maximum biological response of the agonist. Thus, the IC50 value for any anti-TL1A antibody or functional fragment thereof can be calculated by determining the concentration of the antibody or fragment needed to inhibit half of the maximum biological response of TL1A in activating the human TL1A receptor in any functional assay, such as the assay described in Example 14 hereinafter. An antibody or functional fragment thereof that selectively inhibits a specific ligand or receptor is understood to be a neutralizing antibody or neutralizing fragment with respect to that ligand or receptor. Thus, in some embodiments, the anti-TL1A antibody or functional fragment thereof from which the anti-TL1A binding domain of the bispecific antigen binding proteins of the invention is derived is a neutralizing antibody or fragment of human TL1A.

The variable regions or CDR regions of any anti-TL1A antibody or functional fragment thereof can be used to construct the anti-TL1A binding entity of any of the bispecific antigen binding proteins described herein. Likewise, the variable regions or CDR sequences of any anti-TNF-α antibody or functional fragment thereof can be used to construct the anti-TNF-α binding entity of any of the bispecific antigen binding proteins described herein. For instance, the anti-TL1A binding domain of the bispecific antigen binding proteins of the invention may comprise VH and/or VL regions or one or more CDRs from any of the anti-human TL1A antibodies described in U.S. Pat. No. 7,820,798; US Pat. App. 2008/0003221; U.S. Pat. No. 8,263,743; US Pat. App. 2011/0217310; US Pat. App. 2012/0263718; US Pat. App. 2014/0308271; WO 2012/161856; WO 2013/044298; WO 2005/018571; US Pat. App. 2014/0120109; U.S. Pat. No. 6,521,422; US Pat. App. 2014/0255302; and US Pat. App. 2015/0132311; each of which is hereby incorporated by reference in its entirety. In some embodiments, the anti-TL1A antibody from which the anti-TL1A binding entity is derived cross-blocks one or more of the human anti-TL1A antibodies described in one of the references just mentioned or one or more of the human anti-TL1A antibodies described below. The terms "cross-block," "cross-blocked," and "cross-blocking" are used interchangeably herein to mean the ability of an antibody to interfere with the binding of other antibodies or binding fragments to a target (e.g. human TL1A). The extent to which an antibody or binding fragment is able to interfere with the binding of another to a target (e.g., human TL1A) and therefore whether it can be said to cross-block, can be determined using competition binding assays. In some embodiments, a cross-blocking antibody or binding fragment thereof reduces human TL1A binding of a reference antibody between about 40% and 100%, such as about 60% and about 100%, specifically preferably between about 70% and 100%, and more specifically preferably between about 80% and 100%. A particularly suitable quantitative assay for detecting cross-blocking uses a Biacore machine which measures the extent of interactions using surface plasmon resonance technology. Another suitable quantitative cross-blocking assay uses a FACS-based approach to measure competition between antibodies in terms of their binding to human TL1A. An exemplary assay regarding such cross-blocking appears in US Pat. App. 2015/0132311, example 2, paragraphs [0922]-[0924], hereby incorporated by reference.

The term "nucleic acid" or "nucleic acid molecule" refers to polynucleotides, such as deoxyribonucleic acid (DNA) or ribonucleic acid (RNA), oligonucleotides, fragments generated by the polymerase chain reaction (PCR), and fragments generated by any of ligation, scission, endonuclease action, and exonuclease action. Nucleic acid molecules can be composed of monomers that are naturally-occurring nucleotides (such as DNA and RNA), or analogs of naturally-occurring nucleotides (e.g., .alpha.-enantiomeric forms of naturally-occurring nucleotides), or a combination of both. Modified nucleotides can have alterations in sugar moieties and/or in pyrimidine or purine base moieties. Sugar modifications include, for example, replacement of one or more hydroxyl groups with halogens, alkyl groups, amines, and azido groups, or sugars can be functionalized as ethers or esters. Moreover, the entire sugar moiety can be replaced with sterically and electronically similar structures, such as aza-sugars and carbocyclic sugar analogs. Examples of modifications in a base moiety include alkylated purines and pyrimidines, acylated purines or pyrimidines, or other well-known heterocyclic substitutes. Nucleic acid monomers can be linked by phosphodiester bonds or analogs of such linkages. Analogs of phosphodiester linkages include phosphorothioate, phosphorodithioate, phosphoroselenoate, phosphorodiselenoate, phosphoroanilothioate, phosphoranilidate, phosphoramidate, and the like. The term "nucleic acid molecule" also includes so-called "peptide nucleic acids", which comprise naturally-occurring or modified nucleic acid bases attached to a polyamide backbone. Nucleic acids can be either single stranded or double stranded.

The term "complement of a nucleic acid molecule" refers to a nucleic acid molecule having a complementary nucleotide sequence and reverse orientation as compared to a reference nucleotide sequence.

The term "degenerate nucleotide sequence" denotes a sequence of nucleotides that includes one or more degenerate codons as compared to a reference nucleic acid molecule that encodes a polypeptide. Degenerate codons contain different triplets of nucleotides, but encode the same amino acid residue (i.e., GAU and GAC triplets each encode Asp).

An "isolated nucleic acid molecule" is a nucleic acid molecule that is not integrated in the genomic DNA of an organism. For example, a DNA molecule that encodes a growth factor that has been separated from the genomic DNA of a cell is an isolated DNA molecule. Another example of an isolated nucleic acid molecule is a chemically-synthesized nucleic acid molecule that is not integrated in the genome of an organism. A nucleic acid molecule that has been isolated from a particular species is smaller than the complete DNA molecule of a chromosome from that species A "nucleic acid molecule construct" is a nucleic acid molecule, either single- or double-stranded, that has been modified through human intervention to contain segments of nucleic acid combined and juxtaposed in an arrangement not existing in nature "Complementary DNA (cDNA)" is a single-stranded DNA molecule that is formed from an mRNA template by the enzyme reverse transcriptase. Typically, a primer complementary to portions of mRNA is employed for the initiation of reverse transcription. Those skilled in the art also use the term "cDNA" to refer to a double-stranded DNA molecule consisting of such a single-stranded DNA molecule and its complementary DNA strand. The term "cDNA" also refers to a clone of a cDNA molecule synthesized from an RNA template.

A "promoter" is a nucleotide sequence that directs the transcription of a structural gene. Typically, a promoter is located in the 5' non-coding region of a gene, proximal to the transcriptional start site of a structural gene. Sequence elements within promoters that function in the initiation of transcription are often characterized by consensus nucleotide sequences. These promoter elements include RNA polymerase binding sites, TATA sequences, CAAT sequences, differentiation-specific elements (DSEs; McGehee et al., Mol. Endocrinol., 7:551 (1993)), cyclic AMP response elements (CREs; Treisman, Seminars in Cancer Biol., 1:47 (1990)), glucocorticoid response elements (GREs), and binding sites for other transcription factors, such as CRE/ATF (O'Reilly et al., J. Biol. Chem., 267:19938 (1992)), AP2 (Ye et al., J. Biol. Chem., 269:25728 (1994)), SP1, cAMP response element binding protein (CREB; Loeken, Gene Expr., 3:253 (1993)) and octamer factors (see, in general, Watson et al., eds., Molecular Biology of the Gene, 4th Edition, The Benjamin/Cummings Publishing Company, Inc. (1987), and Lemaigre et al., Biochem. J., 303:1 (1994)). If a promoter is an inducible promoter, then the rate of transcription increases in response to an inducing agent. In contrast, the rate of transcription is not regulated by an inducing agent if the promoter is a constitutive promoter. Repressible promoters are also known.

A "regulatory element" is a nucleotide sequence that modulates the activity of a core promoter. For example, a regulatory element may contain a nucleotide sequence that binds with cellular factors enabling transcription exclusively or preferentially in particular cells, tissues, or organelles. These types of regulatory elements are normally associated with genes that are expressed in a "cell-specific", "tissue-specific", or "organelle-specific" manner.

An "enhancer" is a type of regulatory element that can increase the efficiency of transcription, regardless of the distance or orientation of the enhancer relative to the start site of transcription.

"Heterologous DNA" refers to a DNA molecule, or a population of DNA molecules, that does not exist naturally within a given host cell. DNA molecules heterologous to a particular host cell may contain DNA derived from the host cell species (i.e., endogenous DNA) so long as that host DNA is combined with non-host DNA (i.e., exogenous DNA). For example, a DNA molecule containing a non-host DNA segment encoding a polypeptide operably linked to a host DNA segment comprising a transcription promoter is considered to be a heterologous DNA molecule. Conversely, a heterologous DNA molecule can comprise an endogenous gene operably linked with an exogenous promoter. As another illustration, a DNA molecule comprising a gene derived from a wild-type cell is considered to be heterologous DNA if that DNA molecule is introduced into a mutant cell that lacks the wild-type gene.

An "expression vector" is a nucleic acid molecule encoding a gene that is expressed in a host cell. Typically, an expression vector comprises a transcription promoter, a gene, and a transcription terminator. Gene expression is usually placed under the control of a promoter, and such a gene is said to be "operably linked to" the promoter. Similarly, a regulatory element and a core promoter are operably linked if the regulatory element modulates the activity of the core promoter.

A "recombinant host" is a cell that contains a heterologous nucleic acid molecule, such as a cloning vector or expression vector. In the present context, an example of a recombinant host is a cell that produces an antagonist of the present invention from an expression vector. In contrast, such an antagonist can be produced by a cell that is a "natural source" of said antagonist, and that lacks an expression vector.

The terms "amino-terminal" and "carboxyl-terminal" are used herein to denote positions within polypeptides. Where the context allows, these terms are used with reference to a particular sequence or portion of a polypeptide to denote proximity or relative position. For example, a certain sequence positioned carboxyl-terminal to a reference sequence within a polypeptide is located proximal to the carboxyl terminus of the reference sequence, but is not necessarily at the carboxyl terminus of the complete polypeptide.

A "fusion protein" is a hybrid protein expressed by a nucleic acid molecule comprising nucleotide sequences of at least two genes. For example, a fusion protein can comprise at least part of a IL-17RA polypeptide fused with a polypeptide that binds an affinity matrix. Such a fusion protein provides a means to isolate large quantities of IL-17A using affinity chromatography.

The term "receptor" denotes a cell-associated protein that binds to a bioactive molecule termed a "ligand." This interaction mediates the effect of the ligand on the cell. Receptors can be membrane bound, cytosolic or nuclear; monomeric (e.g., thyroid stimulating hormone receptor, beta-adrenergic receptor) or multimeric (e.g., PDGF receptor, growth hormone receptor, IL-3 receptor, GM-CSF receptor, G-CSF receptor, erythropoietin receptor and IL-6 receptor). Membrane-bound receptors are characterized by a multi-domain structure comprising an extracellular ligand-binding domain and an intracellular effector domain that is typically involved in signal transduction. In certain membrane-bound receptors, the extracellular ligand-binding domain and the intracellular effector domain are located in separate polypeptides that comprise the complete functional receptor. In general, the binding of ligand to receptor results in a conformational change in the receptor that causes an interaction between the effector domain and other molecule(s) in the cell, which in turn leads to an alteration in the metabolism of the cell. Metabolic events that are often linked to receptor-ligand interactions include gene transcription, phosphorylation, dephosphorylation, increases in cyclic AMP production, mobilization of cellular calcium, mobilization of membrane lipids, cell adhesion, hydrolysis of inositol lipids and hydrolysis of phospholipids.

The term "expression" refers to the biosynthesis of a gene product. For example, in the case of a structural gene, expression involves transcription of the structural gene into mRNA and the translation of mRNA into one or more polypeptides.

The term "complement/anti-complement pair" denotes non-identical moieties that form a non-covalently associated, stable pair under appropriate conditions. For instance, biotin and avidin (or streptavidin) are prototypical members of a complement/anti-complement pair. Other exemplary complement/anti-complement pairs include receptor/ligand pairs, antibody/antigen (or hapten or epitope) pairs, sense/antisense polynucleotide pairs, and the like. Where subsequent dissociation of the complement/anti-complement pair is desirable, the complement/anti-complement pair preferably has a binding affinity of less than $10^9 M^{-1}$.

A "detectable label" is a molecule or atom which can be conjugated to an antibody moiety to produce a molecule useful for diagnosis. Examples of detectable labels include chelators, photoactive agents, radioisotopes, fluorescent agents, paramagnetic ions, or other marker moieties.

The term "affinity tag" is used herein to denote a polypeptide segment that can be attached to a second polypeptide to provide for purification or detection of the second polypeptide or provide sites for attachment of the second polypeptide to a substrate. In principal, any peptide or protein for which an antibody or other specific binding agent is available can be used as an affinity tag. Affinity tags include a polyhistidine tract, protein A (Nilsson et al., EMBO J., 4:1075 (1985); Nilsson et al., Methods Enzymol., 198:3 (1991)), glutathione S transferase (Smith et al., Gene, 67:31 (1988)), Glu-Glu affinity tag (Grussenmeyer et al., Proc. Natl. Acad. Sci. USA, 82:7952 (1985)), substance P, FLAG® peptide (Hopp et al., Biotechnology, 6:1204 (1988)), streptavidin binding peptide, or other antigenic epitope or binding domain. See, in general, Ford et al., Protein Expression and Purification, 2:95 (1991). DNA molecules encoding affinity tags are available from commercial suppliers (e.g., Pharmacia Biotech, Piscataway, N.J.).

The term "acidic residue" refers to amino acid residues having sidechains comprising acidic groups. Exemplary acidic residues include D and E.

The term "amide residue" refers to amino acids having sidechains comprising amide derivatives of acidic groups. Exemplary residues include N and Q.

The term "aromatic residue" refers to amino acid residues having sidechains comprising aromatic groups. Exemplary aromatic residues include F, Y, and W.

The term "basic residue" refers to amino acid residues having sidechains comprising basic groups. Exemplary basic residues include H, K, and R.

The term "hydrophilic residue" refers to amino acid residues having sidechains comprising polar groups. Exemplary hydrophilic residues include C, S, T, N, and Q.

The term "non-functional residue" refers to amino acid residues having sidechains that lack acidic, basic, or aromatic groups. Exemplary non-functional amino acid residues include M, G, A, V, I, L and norleucine (Nle).

Both the EU index as in Kabat et al. (1991), *Sequences of Proteins of Immunological Interest,* 5th Ed. Public Health Service, National Institutes of Health, Bethesda, Md. and AHo numbering schemes (Honegger and Plückthun (2001), *J Mol Biol.* 8; 309(3): 657-70) can be used in the present invention. Amino acid positions and CDRs and FRs of a given antibody may be identified using either system. For example, EU heavy chain positions 39, 44, 183, 356, 357, 370, 392, 399, and 409 are equivalent to AHo heavy chain positions 46, 51, 230, 484, 485, 501, 528, 535, and 551, respectively. Similarly, EU light chain positions 38, 100, and 176 are equivalent to AHO light chain positions 46 141, and 230, respectively. Tables (i), (ii) and (iii) below demonstrate the equivalence between numbering positions for v1, v2, and v3 versions of charge positions to aid correct assembly of, for example, IgG-Fab bispecific antigen binding proteins.

TABLE (i)

| Chain | Domain | Mutation | AHo # | EU # | Kabat # |
|---|---|---|---|---|---|
| | | v1 | | | |
| LC-E | Constant | E | 230 | 176 | 176 |
| LC-K | Constant | K | 230 | 176 | 176 |
| HC-E | CH1 | E | 230 | 183 | 188 |
| HC-K | CH1 | K | 230 | 183 | 188 |

TABLE (ii)

| Chain | Domain | Mutation | AHo # | EU # | Kabat # |
|---|---|---|---|---|---|
| | | v2 | | | |
| LC-E | Variable | E | 46 | 38 | 38 |
| | Constant | E | 230 | 176 | 176 |
| LC-K | Variable | K | 46 | 38 | 38 |
| | Constant | K | 230 | 176 | 176 |
| HC-E | Variable | E | 46 | 39 | 39 |
| | CH1 | E | 230 | 183 | 188 |
| HC-K | Variable | K | 46 | 39 | 39 |
| | CH1 | K | 230 | 183 | 188 |

TABLE (iii)

| Chain | Domain | Mutation | v3 AHo # | EU # | Kabat # |
|---|---|---|---|---|---|
| LC-E | Variable | E | 141 | 100 | 100 |
|  | Constant | E | 230 | 176 | 176 |
| LC-K | Variable | K | 141 | 100 | 100 |
|  | Constant | K | 230 | 176 | 176 |
| HC-E | Variable | E | 51 | 44 | 44 |
|  | CH1 | E | 230 | 183 | 188 |
| HC-K | Variable | K | 51 | 44 | 44 |
|  | CH1 | K | 230 | 183 | 188 |

Bispecific Antigen Binding Protein Formats of the Invention

One aspect of the invention concerns novel TL1A-specific antigen binding proteins and antibodies. Such antibodies are useful to treat conditions known in the art and described hereinafter that are amenable to treatment by inhibition of TL1A biological activity.

Another aspect of the invention concerns bispecific antigen binding proteins in which one light chain-heavy chain pair specifically binds TL1A and another light chain-heavy chain pair binds TNF-α. Such bispecific antigen binding proteins can be whole antibodies (see FIG. 1) or F(ab')$_2$ fragments. In this aspect of the invention, the TL1A binding entity is monovalent for TL1A and the TNF-α binding entity is monovalent for TNF-α.

In another bispecific antigen binding protein embodiment, the TL1A binding entity and the TNF-α binding entity are arranged in an overall structure referred to herein as IgG-scFv. In this embodiment, a first binding entity has the structure of an antibody—i.e., two pairs of immunoglobulin chains, each pair having one light chain and one heavy chain. A second binding entity comprises the structure of a pair of Fv units—i.e., each member of the pair has a variable domain from a heavy chain and a variable domain from a light chain linked in tandem as a single chain. In the IgG-scFv configuration, each Fv unit is covalently bound to the C-terminus of a heavy chain constant domain (Fc) of the first binding entity (see FIG. 2). Each Fv unit can be linked to the Fc domain of the first binding entity directly or through a linker. In this embodiment of the invention, each binding entity is bivalent for its target antigen. In a preferred embodiment, the TL1A binding entity has the structure of an antibody and the TNF-α binding entity has the structure of a pair of Fv units.

The invention further concerns bispecific antibodies with mutations to aid correct heavy-heavy and heavy-light chain pairing. Such mutations are described in U.S. Pat. No. 8,592,562; WO 2009/089004; WO 2006/106905; WO 2014/4082179; WO 2014/081955; Speiss et al., Mol. Immunol. (2015), http://dx.doi.org/10.1016/j.molimm.2015.01.003; each of which is hereby incorporated by reference.

The invention further concerns a TL binding entity and a TNF-α binding entity arranged in other bispecific antigen binding protein formats known in the art. Specifically, the invention concerns the TL1A and TNF-α binding entities in the formats described in: WO 2014/159 725; WO 2013/041687; U.S. Pat. Nos. 8,945,553; 8,945,553; 8,258,268; US Pat. App. No. 2012/0195900; International patent application WO 2012/088 302; U.S. Prov. App. 62/218,977; Fischer and Leger (2007), Pathobiology 74:3-14; van Spriel et al. (2000), Immunology Today 21(8): 391-7; Kufer et al. (2004), Trends in Biotechnology 22(5): 238-44; Byrne et al. (2013), Trends in Biotechnology 31(11): 621-31; Muller and Kontermann (2010), Biodrugs 24(2): 89-98; Chames and Baty (2009), http://dx.doi.org/10.4161/mabs.1.6.10015; Kontermann (2012), http://dx.doi.org/10.4161/mabs.4.2.19000; Holliger et al. (1993), Proc. Natl. Acad. Sci. USA 90: 6444-8; Speiss et al., Mol. Immunol. (2015), http://dx.doi.org/10.1016/j.molimm.2015.01.003; WO 2009/089004, published 16 Jul. 2009; Holliger et al. (1993), Proc. Natl. Acad. Sci. USA 90: 6444-8; Speiss et al., Mol. Immunol. (2015), http://dx.doi.org/10.1016/j.molimm.2015.01.003; Ridgway et al, (1996), Protein Eng. 9: 617; Gunasekaran et al (2010), J. Biol. Chem. 285:19637; Davis (2010), Protein Eng. Des. & Sel. 23:195; DiGiammarino et al. (2012), Methods Mol. Biol. 899:145, 2012); Lindhofer et al. (1995), J. Immunol. 155: 219: Schaefer et al. (2011), Proc. Natl. Acad. Sci. USA, 108: 11187; Regula et al, US Patent Application No: 2010/0322934; Bostrom et al. (2009), Science 323:1610; US Pat. App. 2011/0076722; Rossi et al. (2008), Cancer Res. 68:8384; each of which is hereby incorporated by reference.

Preferred Embodiments

The amino acid sequences of the antigen binding proteins and binding entities are preferably based upon the sequences of human and/or humanized monoclonal antibodies against TL1A and TNF-α. The invention also comprises sequences having at least 90%, at least 95%, or at least 99% sequence identity to the preferred sequences set forth hereinafter. The amino acid sequences shown in the following tables are preferred for the antigen binding proteins of this invention, including bispecific antigen binding proteins in any format.

TL1A-Specific Antigen Binding Proteins

TL1A-specific antigen binding proteins and antigen binding entities preferably comprise the complementarity determining region (CDR) sequences derived from preferred TL1A antibodies disclosed herein. Table A shows the preferred CDR sequences, alongside the preferred antibodies from which they were derived. Throughout, LCDR1, LCDR2, and LCDR3 refer to the light chain CDRs; HCDR1, HCDR2, and HCDR3 to the heavy chain CDRs, Throughout, the sequence identification number (SEQ ID NO) for each sequence appears in parentheses after the sequence in the table.

TABLE A

Preferred TL1A-binding CDR sequences

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 3C6 | RTSQDIRD DLG (98) | DASSLQS (100) | LQHNSYPP T (102) | SYGMH (164) | VISYDGNN KLYTDSVK G (166) | PTVTLYYY YGMDV (168) |
| 2G11 | RASQSINN YLN (110) | ATSSLQS (106) | QQSYSTPR T (108) | SYFWS (170) | YIYYSGST NYNPSLKS (172) | EIGSYYGF DY (174) |

TABLE A-continued

Preferred TL1A-binding CDR sequences

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 9C8 | RASQSINNYLN (110) | AASSLQS (112) | QQSYSTPRT (108) | SYFWS (170) | YIYYSGNTKYNPSLKS (178) | ETGSYYGFDY (180) |
| 23B3 | KSSQSVLYSSNNKNYLV (116) | WASTRES (118) | QQYYKTPLT (120) | TNSVAWN (182) | RTYYRSKWYNDYAVSVKS (184) | EDGDSYYRYGMDV (186) |
| 23B3 VH4 | RSSQSVLYSSNNKNYLV (128) | WASTRES (118) | QQYYKTPLT (120) | TNSVAWN (182) | RTYYRSKWYNDYAVSLKS (196) | EDGDSYYRYGMDV (186) |
| 23B3 VH3 | RSSQSVLYSSNNKNYLV (128) | WASTRES (118) | QQYYKTPLT (120) | TNSVAWN (182) | RTYYRSKWYNDYAVSVKG (202) | EDGDSYYRYGMDV (186) |
| 3B3 | RASQSVRSSYLA (122) | GASSRAT (124) | QQYGSSPT (126) | GYYWN (188) | EINHAGNTNYNPSLKS (190) | GYCRSTTCYFDY (192) |
| 5G4 | RASQSVRSSYLA (122) | GASSRAT (124) | QQYGSSPT (126) | GYYWN (188) | EINHSGITNYNPSLKS (483) | GYCRSTTCYFDY (192) |
| 17E9 | RASQGISNDLA (469) | AASSLQS (112) | LQHNSYPPT (102) | SYGMH (164) | VMSYDGNNKLYADSVKG (485) | DETETLYYYYGIDV (489) |
| 53D3 | RSSQSLLYSNGYNYLD (683) | LGSSRAS (685) | MQPLQTPLT (687) | TYYMS (777) | SISSSSSFIYYADSVKG (779) | DRIAAPGTYYYYGMDV (781) |
| 54E5 | KSSQNILYSSNNKNYLA (689) | WASTRES (118) | QQYYSIPWT (693) | TYGMH (783) | VIWYDGSNKDYADSVKG (785) | EERDSYYHYGMDV (787) |
| 56E1 | KSSQSVLYSSNNKNYLA (235) | WASTRES (118) | QQYYSIPWT (693) | SYGMH (164) | VIWYDGSNKDYADSVKG (785) | EERDSYYHYGMDV (787) |
| 57A8 | TGSSSNIGAGYNVH (697) | GNNNRPS (699) | QSYDSSLSGWV (701) | SYVMS (792) | VISGSGGSTYYADSVKG (794) | GGTNYYYYSGMDV (796) |
| 58G5 | TGSSSNIGAGYDVH (146) | GNSHRPS (705) | QSYDSSLSGYV (707) | NYAMS (798) | VISGRGGSTYYADSVKG (800) | DGYSSAWYFDY (802) |
| 60G11 | TGSGSNIGAGYDVH (709) | GNSHRPS (705) | QSYDSSLSGYV (707) | NYAMN (804) | VISGRGGSTYYADSVKG (800) | DGYSSAWFFDY (807) |
| 73C2 | RASQSFSSYLN (713) | AASSLQS (112) | QQSYSTPRS (717) | SSSATWN (809) | RTYQRSKWNNDYAVSVKS (811) | EVVAGPRWFDP (813) |
| 76A4 | RASQSVTSYLN (719) | TASSLQS (721) | QQSYSTPRS (717) | SNSATWN (815) | RTYYRSKLYNDYAVSVKS (817) | EVVAGPRWFDP (813) |
| 77D12 | SESNSDIGTNAVN (723) | SNNKRPS (725) | ATWDDNLNGPL (727) | GFYMH (819) | WINPDSGGTNYAQKFQG (821) | EGIAVALTY (823) |
| 87H11 | RASQSISSYLN (229) | VASSLQS (731) | QQSYSNPQECS (733) | GYYWS (265) | EINHSGRTNYNPSLKS (827) | DSGWHFSFDI (829) |
| 88H9 | RASQGIRNDLG (226) | AASGLQG (737) | LQHNSYPTWT (739) | SYGMH (164) | VIWFDGSNEYYADSVKG (832) | ERWFGELLDY (834) |

TABLE A-continued

Preferred TL1A-binding CDR sequences

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 89H9 | RASQSISYYLN (741) | AASSLQS (112) | QQSYSSIT (745) | SYAMS (836) | GISGGGGSTYYADSVKG (838) | EMAGAFDI (840) |
| 91D7 | RASQNISSYLN (747) | TASSLQS (749) | QQSYSNPPESS (751) | GYYWS (265) | EINPVGRTNYKPSLKS (843) | DNGWHYAFDI (845) |
| 91F10_LC1 | RSSQSLVYSDGNTYLN (753) | KVSNWDS (755) | MQGTHWP (757) | AYYMH (847) | WINPNSGGTNYAQKFRG (849) | GGSWEGFDY (851) |
| 91F10_LC2 | RASQSISSYLN (229) | AASRLQS (761) | QQSDSTPIT (763) | AYYMH (847) | WINPNSGGTNYAQKFRG (849) | GGSWEGFDY (851) |
| 91G8 | RASQSISSYLN (229) | AASSLQS (112) | QQSFSTIT (767) | SYAMS (836) | GISGSGGSRYYADSVKG (853) | EVAGAFDI (855) |
| 92D3 | RASQSISSYLN (229) | GASRLQS (769) | QQSDTTPIT (771) | GYYMH (857) | WIIPNSGGTNYAQKFQG (859) | GSSWEGFDY (861) |
| 92E5 | RASQSISHYLN (773) | AASSLQS (112) | QQSFSSIT (775) | SYAMS (836) | GISGRGGSTYYADSVKG (864) | EVAGAFDI (855) |

Each of the foregoing sequences is encoded by the nucleic acid sequence immediately preceding it in the Sequence Listing. Throughout, the sequences from antibodies 9C8 and 3B3 are preferred.

In the antigen binding proteins of this invention, it is preferable to avoid isomerization sites. The two-amino acid sequences DG, DH, DS, and DT are known isomerization sites. The present invention relates also to antigen binding proteins in which the source antibody sequences, including the sequences of CDRs, are modified to eliminate isomerization sites. With that consideration, the invention relates to antigen binding proteins wherein HCDR2 is a modified form of the HCDR2 from source antibody 3C6 having the sequence VISYDXNNKLYTDXVKG (SEQ ID NO: 204) wherein each X is independently a residue other than G, H, S, or T (i.e., A, C, D, E, F, I, K, L, M, N, P, Q, R, V, W, or Y), with A preferred. The invention further relates to antigen binding proteins wherein HCDR2 is a modified form of the HCDR2 from source antibody 3C6 in which the acidic residue D is replaced with E so as to remove the isomerization sites, resulting in the sequence VISYEGNNKLYTESVKG (SEQ ID NO: 678). The invention further relates to antigen binding proteins wherein HCDR3 is a modified form of HCDR3 from source antibody 23B3 having the sequence EDGDXYYRYGMDV (SEQ ID NO: 676). The invention further relates to antigen binding proteins wherein the isomerization site of HCDR3 from source antibody 23B3 is removed by replacing the acidic residue D with E, resulting in the sequence EEGESYYRYGMDV (SEQ ID NO: 657).

In the antigen binding proteins of this invention, it is preferable to avoid deamidation sites. The two-amino acid sequences NG, NH, NS, and NT are known deamidation sites. The present invention relates also to antigen binding proteins in which the source antibody sequences, including the sequences of CDRs, are modified to eliminate deamidation sites. One way to eliminate the deamidation sites is to replace the second amino acid residue in the sites NG, NH, NS, and NT with a residue other than G, H, S, or T (i.e., A, C, D, E, F, I, K, L, M, N, P, Q, R, V, W, or Y). A preferred way to eliminate deamidation sites is to replace the N in NG, NH, NS and NT with Q. With that consideration, the invention relates to antigen binding proteins having the following sequences in addition to those listed in Table A:

LCDR3 may have the sequence LQHQSYPPT (SEQ ID NO: 631) based on modification of the sequence from the source antibody 3C6;

HCDR1 may have the sequences TQSVAWN (SEQ ID NO: 632) based on modification of the sequence from the source antibody 23B3 VH4;

HCDR2 may have the sequences YIYYSGQTKYNPSLKS (SEQ ID NO: 633) or EIQHAGQTNYNPSLKS (SEQ ID NO: 677) based on modification of the sequences from the source antibodies 9C8 and 3B3, respectively.

Antigen binding proteins of this invention may further result from substitution of an acidic residue for another acidic residue, an amide residue for another amide residue, and likewise for aromatic residues, basic residues, hydrophilic residues, non-functional residues, neutral polar residues, and polar hydrophobic residues. Such substitutions of non-functional residues of the source antibody CDRs results in the sequences of the invention shown in Table B, wherein each X is independently M, G, A, V, I, or L.

TABLE B

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 3C6 | RTSQDXRDDLX (635) | DXSSLQS (636) | XQHQSYPPT (637), XQHNXYPPT (638), LQHQSYPPT (631), | SYXXH (639) | XXSYDXNNKKYTDXXKX (640), VISYDXNNKLYTDXVKG (204), VISYEGNNKLYTESVKG (678), XXSYEXNNKLYTESXKX (679) | PTXTXYYYYXXDV (641) |
| 2G11 | RXSQSXNNYLN (642) | XTSSXQS (643) | QQSYSTPRT (108) | SYFWS (170) | YXYYSXSTNYNPSXKS (644) | EXXSYYXFDY (645) |
| 9C8 | RXSQSXNNYXN (646) | XXSSXQS (647) | QQSYSTPRT (108) | SYFWS (170) | YXYYSXQTKYNPSXKS (648), YXYYSXNXKYNPSXKS (649), YIYYSGQTKYNPSLKS (633) | ETXSYYXFDY (650) |
| 23B3 | KSSQSVXYSSNNKNYXX (651) | WXSTRES (652) | QQYYKTPXT (653) | TQSXXWN (654), TNXXXWN (655), TQSVAWN (632) | RTYYRSKWYNDYXVSXKS (656) | EDXDSYYRYXXDV (657), EDGDXYYRYGMDV (676), EEGESYYRYGMDV (680), EEXESYYRYXXDX (681) |
| 23B3 VH4 | RSSQSVXYSSNNKNYXX (658) | WXSTRES (652) | QQYYKTPXT (653) | TQSXXWN (654), TNXXXWN (655), TQSVAWN (632) | RTYYRSKWYNDYXXSXKS (659) | EDXDSYYRYXXDV (657), EDGDXYYRYGMDV (676), EEGESYYRYGMDV (680), EEXESYYRYXXDX (681) |
| 23B3 VH3 | RSSQSVXYSSNNKNYXX (658) | WXSTRES (652) | QQYYKTPXT (653) | TQSXXWN (654), TNXXXWN (655), TQSVAWN (632) | RTYYRSKWYNDYXXSVKX (660) | EDXDSYYRYXXDV (657), EDGDXYYRYGMDV (676), EEGESYYRYGMDV (680), EEXESYYRYXXDX (681) |

TABLE B-continued

TL1A-binding CDR sequences with substitutions

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 3B3 | RXSQSVRSSYXX (661) | XXSSRXT (662) | QQYXSSPT (663) | XYYWN (664) | EXNHXXNTNYNPSXKS (665), EXNHXXNTNYNPSXKS (666), EIQHAGQTNYNPSLKS (677) | XYCRSTTCYFDY (667) |
| 5G4 | RXSQSXRSSYXX (668) | XXSSRXT (662) | QQYXSSPT (663) | XYYWN (664) | EXNXSXXTNYNPSXKS (114), EIQHSGITNYNPSLKS (227), XQHSXXTNYNPSXKS (230) | XYCRSTTCYFDY (667) |
| 17E9 | RXSQXXSNDX (646) | XXSSXQS (647) | XQHQSYPPT (637), XQHNSYPPT (233) | SYXXH (639) | VMSYDXNNKLYADXVKG (691), VMSYEGNNKLYAESVKG (715), XXSYDXNNKXYXDSXKX (669), XXSYEXNNKXYXESXKX (711) | DETETXYYYYXXDX (671) |
| 53D3 | RSSQSXXYSNXYNYXD (759), RSSQSLLYSQGYNYLD (743), RSSQSXXYSQXYNYXD (765) | XXSSRXS (789) | XQPXQTPXT (940) | TYYXS (955) | SISSSSSFIYYADXVKG (971), SISSSSSFIYYAESVKG (972), SXSSSSSFXYYXDSXKX (973), SXSSSSSFXYYXESXKX (974), SXSSSSSFXYYXDXXKX (975) | DRXXXPXTYYYYXXDX (976) |
| 54E5 | KSSQNXLYSSNNKNYXX (977) | WXSTRES (652) | QQYYSXPWT (978) | TYXXH (979) | VIWYDXSNKDYADXVKG (980), VIWYEGSNKDYAESVKG (981), XXWYDXSNKDYXDSXKX (982), XXWYDXSNKDYXDXVKG (983), XXWYEXSNKDYXESXKG (984) | EERDSYYHYXXDX (985) |
| 56E1 | KSSQSXXYSSNNKNYXX (986) | WXSTRES (652) | QQYYSXPWT (978) | SYXXH (639) | VIWYDXSNKDYADXVKG (980), VIWYEGSNKDYAESVKG (981), XXWYDXSNKDYXDSX | EERDSYYHYXXDX (985) |

TABLE B-continued

TL1A-binding CDR sequences with substitutions

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| | | | | | KX (982), XXWYDXSNKDYXDXVKG (983), XXWYEXSNKDYXESXKG (984) | |
| 57A8 | TXSSSNXXXXYNXH (987) | XNNNRPS (988) | QSYDXSLSGWV (989), QSYESSLSGWV (990), QSYDSSXSXWX (991), QSYDXSXSXWV (992), QSYESSXSXWV (993) | SYXXS (994) | VISGSGGSTYYADXVKG (995), VISGSGGSTYYAESVKG (996), XXSXSXXSTYYXDSKXX (997), XXSXSXXSTYYXDXKX (998), XXSXSXXSTYYXESXKX (999) | XXTNYYYYYSXXDX (1000) |
| 58G5 | TXSSSNXXXXYDXH (1001) | XNXHRPS (1002), GQSHRPS (1003), XQSHRPS (1004) | QSYDXSLSGYV (1005), QSYESSLSGYV (1006), QSYDSSXSXYX (1007), QSYDXSXSXYX (1008), QSYESSXSXYX (1009) | NYXXS (1010) | XXSXRXXSTYYXDSKXX (1011) | DXYSSAWYFDY (1012), EGYSSAWYFDY (1013), DXYSSXWYFDY (1014), EXYSSXWYFDY (1015) |
| 60G11 | TXSXSNXXXXYDXH (1016) | XNSHRPS (1002), GQSHRPS (1003), XQSHRPS (1004) | QSYDSSXSXYX (1007) | NYXXN (1017) | XXSXRXXSTYYXDSKXX (1011) | DXYSSAWFFDY (1018), EGYSSAWFFDY (1019), DXYSSXWFFDY (1020) |
| 73C2 | RXSQSFSSYXN (1021) | XXSSXQS (647) | [none] | SSSXTWN (1022) | RTYQRSKWNNDYXXSXKS (1023) | EXXXXPRWFDP (1024) |
| 76A4 | RXSQSXTSYXN (1025) | TXSSXQS (1026) | [none] | SNSXTWN (1027), SQSATWN (1028), SQSXTWN (1029) | RTYYRSKXYNDYXXSXKS (1030) | EXXXXPRWFDP (1024) |
| 77D12 | SESNXDXXTNXXN (1031), SESQSDIGTNAVN (1032), SESQSDXXTNXXN (1033) | [none] | XTWDDNXNXPX (1034), ATWDDNLQGPL (1035), XTWDDNXQXPX (1036) | XFYXH (1037) | WINPDXGGTNYAQKFQG (1038), WINPESGGTNYAQKFQG (1039), WXNPDSXXTNYXQKFQX (1040), WXNPDXXXTNYXQKFQX (1041), WXNPESXXTNYXQKFQX (1042) | EXXXXXXTY (1043) |

TABLE B-continued

TL1A-binding CDR sequences with substitutions

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 87H11 | RXSQSXSS YXN (1044) | XXSSXQS (647) | [none] | XYYWS (1045) | EXNXSXRT NYNPSXKS (1046), EIQHSGRT NYNPSLKS (1047) EXQHSXRT NYNPSXKS (1048) | DXGWHFS FDI (1049), ESGWHFS FDI (1050), DSXWHFSF DX (1051), ESXWHFSF DX (1052) |
| 88H9 | RXSQXXRN DLX (1053) | XXSXXQX (1054) | XQHNSYPT WT (1055), LQHQSYPT WT (1056) XQHQSYPT WT (1057) | SYXXH (639) | VIWFDXSN EYYADXVK G (1058), VIWFEGSN EYYADSVK G (1059), VIWFDGSN EYYAESVK G (1060), VIWFEGSN EYYAESVK G (1061), XWFDXSN EYYXDSXK X (1062) | ERWFXEXX DY (1063) |
| 89H9 | RXSQSXSY YXN (1064) | XXSSXQS (647) | QQSYSSXT (1065) | SYXXS (994) | GISGGGGS TYYADXVKG (1066), GIS GGGGSTY YAESVKG (1067), XXSXXXXS TYYXDSXK X (1068), XXSXXXXS TYYXDXXKX (1069), XXS XXXXSTYY XESXKX (1070) | EXXXXFDX (1071) |
| 91D7 | RXSQNXSS YXN (1072) | TXSSXQS (1073) | [none] | XYYWS (1045) | EXNPXXRT NYKPSXKS (1074) | DNXWHYX FDX (1075), DQGWHYA FDI (1076), DQXWHYX FDX (1077) |
| 91F10_LC1 | RSSQSXXY SDXNTYXN (1078), RSSQSLVY SDGQTYLN (1079), RSSQSXXY SDXQTYXN (1080) | KVSNWDX (1081), KVS NWES (1082), KXSNWDS (1083), KXSNWDX (1084), KXSNWES (1085) | XQXTHWP KVS (1086) | XYYXH (1087) | WXNPNXX XTNYXQKF RX (1088), WINPQSGG TNYAQKFR G (1089), WXNPQSX XTNYXQKF RX (1090) | XXSWEXFD Y (1091) |
| 91F10_LC2 | RXSQSXSS YXN (1044) | XXSRXQS (1092) | QQSDSTPX T (1093) | XYYXH (1087) | WXNPNXX XTNYXQKF RX (1088), WINPQSGG TNYAQKFR G (1089), WXNPQSX XTNYXQKF RX (1090) | XXSWEXFD Y (1091) |
| 91G8 | RXSQSXSS YXN (1044) | XXSSXQS (647) | QQSFSTXT (1094) | SYXXS (994) | GISGSGGS RYYADXVK G (1095), | EXXXXFDX (1071) |

TABLE B-continued

TL1A-binding CDR sequences with substitutions

| Source Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
|  |  |  |  |  | XXSXSXXS RYYXDSXKX (1096), XXSXSXXS RYYXDXXKX (1097) |  |
| 92D3 | RXSQSXSSYXN (1044) | XXSRXQS (1098) | QQSDXTPIT (1099), QQSDTTPXT (1100), QQSDXTPXT (1101) | XYYXH (1087) | WXXPNXXXTNYXQKFQX (1102), WIIPQSGGTNYAQKFQG (1103), WXXPQSXXTNYXQKFQX (1104) | XSSWEXFDY (1105) |
| 92E5 | RXSQSXSHYXN (1106) | XXSSXQS (647) | QQSFSSXT (1107) | SYXXS (994) | GISGRGGSTYYADXVKG (1108), GISGRGGSTYYAESVKG (1109), XXSXRXXSTYYXDSVKX (1110), XXSXRXXSTYYXDXVKX (1111), XXSXRXXSTYYXESVKX (1112) | EXXXXFDX (1071) |

Also preferred are antigen binding proteins comprising the CDR germline sequences related to the antibodies shown in Table A. Such sequences are shown in Table C.

TABLE C

Related germline CDR sequences of anti-TL1A antibodies

| Antibody designation related to germline | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 3C6 | RASQGIRNDLG (226) | AASSLQS (112) | LQHNSYPWT (228) | SYAMH (253) | VISYDGSNKYYADSVKG (254) | TTVTYYYYGMD (255) |
| 2G11 | RASQSISSYLN (229) | AASSLQS (112) | QQSYSTPWT (231) | SYYWS (256) | YIYYSGSTNYNPSLKS (172) | SYYYFD (258) |
| 9C8 | RASQSISSYLN (229) | AASSLQS (112) | QQSYSTPYT (234) | SYYWS (259) | YIYYSGSTNYNPSLKS (260) | LTGYFD (261) |
| 23B3 | KSSQSVLYSSNNKNYLA (235) | WASTRES (118) | QQYYSTPLT (237) | SNSAAWN (262) | RTYYRSKWYNDYAVSVKS (184) | RDGYNYYYYYGMD (264) |
| 23B3 VH4 | RASQGISNYLA (241) | AASTLQS (242) | QKYNSAPLT (243) | SGSYYWS (268) | YIYYSGSTNYNPSLKS (269) | RDGYNYYYYYGMD (270) |
| 23B3 VH3 | RASQGISNYLA (241) | AASTLQS (242) | QKYNSAPLT (243) | SNYMS (271) | IYSGGSTYADSVKG (272) | RDGYNYYYYYGMD (273) |

TABLE C-continued

Related germline CDR sequences of anti-TL1A antibodies

| Antibody designation related to germline | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 3B3 | RASQSVSSSYLA (238) | GASSRAT (124) | QQYGSSPIT (240) | GYYWS (265) | EINHSGSTNYNPSLKS (266) | GYCSSTSCYTYFD (267) |
| 5G4 | RASQSVSSSYLA (238) | GASSRAT (124) | QQYGSSPIT (240) | GYYWS (265) | EINHSGSTNYNPSLKS (266) | GYCSSTSCYTYFDY (672) |
| 17E9 | RASQGIRNDLG (226) | AASSLQS (112) | LQHNSYPLT (674) | SYAMH (253) | VISYDGSNKYYADSVKG (254) | GTTGTYYYYYGMDV (675) |
| 53D3 | RSSQSLLHSNGYNYLD (1113) | LGSNRAS (935) | MQALQTPLT (936) | SYSMN (950) | SISSSSSYIYYADSVKG (951) | GIAAAGYYYYYGMDV (952) |
| 54E5 | KSSQSVLYSSNNKNYLA (235) | WASTRES (118) | QQYYSTPWT (938) | SYGMH (164) | VIWYDGSNKYYADSVKG (953) | EYSSSSYYYYYGMDV (954) |
| 56E1 | KSSQSVLYSSNNKNYLA (235) | WASTRES (118) | QQYYSTPWT (938) | SYGMH (164) | VIWYDGSNKYYADSVKG (953) | EYSSSSYYYYYGMDV (954) |
| 57A8 | TGSSSNIGAGYDVH (146) | GNSNRPS (148) | QSYDSSLSGWV (701) | SYAMS (836) | AISGSGGSTYYADSVKG (956) | GTTGTYYYYYGMDV (675) |
| 58G5 | TGSSSNIGAGYDVH (146) | GNSNRPS (148) | QSYDSSLSGYV (707) | SYAMS (836) | AISGSGGSTYYADSVKG (956) | RDGYNYYFDY (958) |
| 60G11 | TGSSSNIGAGYDVH (146) | GNSNRPS (148) | QSYDSSLSGYV (707) | SYAMS (836) | AISGSGGSTYYADSVKG (956) | RDGYNYYFDY (958) |
| 73C2 | RASQSISSYLN (229) | AASSLQS (112) | QQSYSTPYT (234) | SNSAAWN (262) | RTYYRSKWYNDYAVSVKS (184) | GIAVAGNWFDP (961) |
| 76A4 | RASQSISSYLN (229) | AASSLQS (112) | QQSYSTPYT (234) | SNSAAWN (262) | RTYYRSKWYNDYAVSVKS (184) | GIAVAGNWFDP (961) |
| 77D12 | SGSSSNIGSNTVN (947) | SNNQRPS (948) | AAWDDSLNGVV (949) | GYYMH (857) | WINPNSGGTNYAQKFQG (963) | SIAARAEYFQH (964) |
| 87H11 | RASQSISSYLN (229) | AASSLQS (112) | QQSYSTPYT (234) | GYYWS (265) | EINHSGSTNYNPSLKS (266) | DYGDYAFDI (966) |
| 88H9 | RASQGIRNDLG (226) | AASSLQS (112) | LQHNSYPWT (228) | SYGMH (164) | VIWYDGSNKYYADSVKG (953) | RWLQLYFDY (967) |
| 89H9 | RASQSISSYLN (229) | AASSLQS (112) | QQSYSTPIT (942) | SYAMS (836) | AISGSGGSTYYADSVKG (956) | VEMATIDAFDI (968) |
| 91D7 | RASQSISSYLN (229) | AASSLQS (112) | QQSYSTPYT (234) | GYYWS (265) | EINHSGSTNYNPSLKS (266) | DYGDYAFDI (966) |
| 91F10_LC1 | RSSQSLVYSDGNTYLN (753) | KVSNRDS (943) | MQGTHWPLT (944) | GYYMH (857) | WINPNSGGTNYAQKFQG (963) | GYSYGYYFDY (969) |
| 91F10_LC2 | RASQSISSYLN (229) | AASSLQS (112) | QQSYSTPIT (942) | GYYMH (857) | WINPNSGGTNYAQKFQG (963) | GYSYGYYFDY (969) |

TABLE C-continued

Related germline CDR sequences of anti-TL1A antibodies

| Antibody designation related to germline | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 91G8 | RASQSISSYLN (229) | AASSLQS (112) | QQSYSTPIT (942) | SYAMS (836) | AISGSGGSTYYADSVKG (956) | SIAARDAFDI (970) |
| 92D3 | RASQSISSYLN (229) | AASSLQS (112) | QQSYSTPIT (942) | GYYMH (857) | WINPNSGGTNYAQKFQG (963) | GSYGYYFDY (969) |
| 92E5 | RASQSISSYLN (229) | AASSLQS (112) | QQSYSTPIT (942) | SYAMS (836) | AISGSGGSTYYADSVKG (956) | SIAARDAFDI (970) |
| 88H9 | RASQGIRNDLG (226) | AASSLQS (112) | LQHNSYPWT (228) | SYGMH (164) | VIWYDGSNKYYADSVKG (953) | RWLQLYFDY (967) |
| 54E5 | KSSQSVLYSSNNKNYLA (235) | WASTRES (118) | QQYYSTPWT (938) | SYGMH (164) | VIWYDGSNKYYADSVKG (953) | EYSSSSYYYYYGMDV (954) |
| 56E1 | KSSQSVLYSSNNKNYLA (235) | WASTRES (118) | QQYYSTPWT (938) | SYGMH (164) | VIWYDGSNKYYADSVKG (953) | EYSSSSYYYYYGMDV (954) |
| 53D3 | RSSQSLLHSNGYNYLD (1113) | LGSNRAS (935) | MQALQTPLT (936) | SYSMN (950) | SISSSSSYIYYADSVKG (951) | GIAAAGYYYYYGMDV (952) |
| 89H9 | RASQSISSYLN (229) | AASSLQS (112) | QQSYSTPIT (942) | SYAMS (836) | AISGSGGSTYYADSVKG (956) | VEMATIDAFDI (968) |
| 91G8 | RASQSISSYLN (229) | AASSLQS (112) | QQSYSTPIT (942) | SYAMS (836) | AISGSGGSTYYADSVKG (956) | SIAARDAFDI (970) |
| 92E5 | RASQSISSYLN (229) | AASSLQS (112) | QQSYSTPIT (942) | SYAMS (836) | AISGSGGSTYYADSVKG (956) | SIAARDAFDI (970) |
| 92D3 | RASQSISSYLN (229) | AASSLQS (112) | QQSYSTPIT (942) | GYYMH (857) | WINPNSGGTNYAQKFQG (963) | GSYGYYFDY (969) |
| 91F10_LC2 | RASQSISSYLN (229) | AASSLQS (112) | QQSYSTPIT (942) | GYYMH (857) | WINPNSGGTNYAQKFQG (963) | GSYGYYFDY (969) |
| 91D7 | RASQSISSYLN (229) | AASSLQS (112) | QQSYSTPYT (234) | GYYWS (265) | EINHSGSTNYNPSLKS (266) | DYGDYAFDI (966) |
| 76A4 | RASQSISSYLN (229) | AASSLQS (112) | QQSYSTPYT (234) | SNSAAWN (262) | RTYYRSKWYNDYAVSVKS (184) | GIAVAGNWFDP (961) |
| 87H11 | RASQSISSYLN (229) | AASSLQS (112) | QQSYSTPYT (234) | GYYWS (265) | EINHSGSTNYNPSLKS (266) | DYGDYAFDI (966) |
| 73C2 | RASQSISSYLN (229) | AASSLQS (112) | QQSYSTPYT (234) | SNSAAWN (262) | RTYYRSKWYNDYAVSVKS (184) | GIAVAGNWFDP (961) |
| 91F10_LC1 | RSSQSLVYSDGNTYLN (753) | KVSNRDS (943) | MQGTHWPLT (944) | GYYMH (857) | WINPNSGGTNYAQKFQG (963) | GSYGYYFDY (969) |
| 60G11 | TGSSSNIGAGYDVH (146) | GNSNRPS (148) | QSYDSSLSGYV (707) | SYAMS (836) | AISGSGGSTYYADSVKG (956) | RDGYNYFDY (958) |

TABLE C-continued

Related germline CDR sequences of anti-TL1A antibodies

| Antibody designation related to germline | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| 58G5 | TGSSSNIG AGYDVH (146) | GNSNRPS (148) | QSYDSSLS GYV (707) | SYAMS (836) | AISGSGGS TYYADSVK G (956) | RDGYNYYF DY (958) |
| 57A8 | TGSSSNIG AGYDVH (146) | GNSNRPS (148) | QSYDSSLS GWV (701) | SYAMS (836) | AISGSGGS TYYADSVK G (956) | GTTGTYYY YYGMDV (675) |
| 77D12 | SGSSSNIG SNTVN (947) | SNNQRPS (948) | AAWDDSL NGVV (142) | GYYMH (857) | WINPNSGG TNYAQKFQ G (963) | SIAARAEYF QH (964) |

Further preferred are antigen binding proteins comprising the variable domain sequences of the preferred anti-TL1A antibodies, as shown in Table D. Throughout, "VH" as shown in Table D refers to the variable domain of the heavy chain, "VL" to that of the light chain. Molecules within this invention may incorporate modifications to the sequences shown in Table D, including truncations or substitutions for stability or other functionality or removal of hotspots (chemical or physical modification of amino acids). Also included within the invention are molecules having at least 90% sequence identity with the sequences shown in Table D.

TABLE D

Variable domain sequences of preferred anti-TL1A antibodies

| Antibody designation | Amino acid sequence (SEQ ID NO) |
|---|---|
| 3C6 VL | DIQMTQSPSSLSASVGDRVTITCRTSQDIRDDLGWYQQKPGKAPKRLIYDASSLQSGV PSRFSGSGSGTEFTLTISSLQPEDFATYYCLQHNSYPPTFGQGTKVEIK (6) |
| 3C6 VH | QVQLVESGGGVVQPGRSLRLSCAASGFTFSSYGMHWVRQAPGKGLEWVAVISYDG NNKLYTDSVKGRFTISRDDSKSTLYLQMNSLRAEDTAVYYCARDPTVTLYYYYGMDV WGQGTTVTVSS (8) |
| 2G11 VL | DIQMTQSPSSLSASVGDRVTITCRASQSINNYLNWYQQKPGIAPKLLIYATSSLQSGVP SRFSGSGSGTDFSLTISSLQPEDFATYFCQQSYSTPRTFGQGTKVEIK (10) |
| 2G11 VH | QVQLQESGPGLVKPSETLSLTCTVSGGSISSYFWSWIRQPPGKGLEWIGYIYYSGSTN YNPSLKSRVTMSIDTSKNQFSLKLSSVTAADTAVYYCAREIGSYYGFDYWGQGALVTV SS (12) |
| 9C8 VL | DIQMTQSPSSLSASVGDRVTITCRASQSINNYLNWYQQRPGKAPKLLIYAASSLQSGV PSRFSGSGSGTDFTLTISSLQPGDFATYYCQQSYSTPRTFGQGTKLEIK (14) |
| 9C8 VH | QVQLQESGPGLVKPSETLSLTCTVSGGSISSYFWSWIRQPPGKGLEWIGYIYYSGNTK YNPSLKSRVTISIDTSKNQFSLKLSSVTAADTAVYYCARETGSYYGFDYWGQGTLVTV SS (16) |
| 23B3 VL | DIVMTQSPDSLAVSLGERATINCKSSQSVLYSSNNKNYLVWYQQKPGQPPKLLIYWAS TRESGVPDRFSGSGSGTDFTLTISSLQAEDVAVYYCQQYYKTPLTFGGGTKVEIK (18) |
| 23B3 VH | QVQLQQSGPGLVKPSQTLSLTCVISGDSVSTNSVAWNWIRQSPSRGLEWLGRTYYR SKWYNDYAVSVKSRITINPDTSKNQFSLQLNSVTPEDTAVYYCAREDGDSYYRYGMD VWGQGTTVIVSS (20) |
| 3B3 VL | EIVLIQSPGILSLSPGERATLSCRASQSVRSSYLAWYQQKPGQAPRLLIYGASSRATG IPDRFSGSGSGTDFTLTISRLEPEDFAVYYCQQYGSSPTFGQGTRLEIK (22) |
| 3B3 VH | QVQLQQWGAGLLKPSETLSLTCAVHGGSFSGYYWNWIRQPPGKGLEWIGEINHAGN TNYNPSLKSRVTISLDTSKNQFSLTLTSVTAADTAVYYCARGYCRSTTCYFDYWGQGT LVTVSS (24) |
| 23B3 VH4 VL | DIQMTQSPSSLSASVGDRVTITCRSSQSVLYSSNNKNYLVWYQQKPGKVPKLLIYWAS TRESGVPSRFSGSGSGTDFTLTISSLQPEDVATYYCQQYYKTPLTFGGGTKVEIK (26) |

TABLE D-continued

Variable domain sequences of preferred anti-TL1A antibodies

| Antibody designation | Amino acid sequence (SEQ ID NO) |
|---|---|
| 23B3 VH4 VH | QVQLQESGPGLVKPSETLSLTCTISGDSVSTNSVAWNWIRQPPGKGLEWIGRTYYRS KWYNDYAVSLKSRVTISPDTSKNQFSLKLSSVTAADTAVYYCAREDGDSYYRYGMDV WGQGTTVTVSS (28) |
| 23B3 VH3 VL | DIQMTQSPSSLSASVGDRVTITCRSSQSVLYSSNNKNYLVWYQQKPGKVPKLLIYWAS TRESGVPSRFSGSGSGTDFTLTISSLQPEDFATYYCQQYYKTPLTFGGGTKVEIK (30) |
| 23B3 VH3 VH | EVQLLESGGGLVQPGGSLRLSCAISGDSVSTNSVAWNWIRQAPGKGLEWVSRTYYR SKWYNDYAVSVKGRFTISPDTSKNIFYLQMNSLRAEDTAVYYCAREDGDSYYRYGM DVWGQGTTVTVSS (32) |
| 5G4 VL | EIVLIQSPGILSLSPGERVILSCRASQSVRSSYLAWYQQRAGQAPRLLIYGASSRATG IPDRFSGSGSGTDFTLTISRLEPEDFAVYYCQQYGSSPTFGQGTRLEIK (491) |
| 5G4 VH | QVQLQQWGAGLLKPSETLSLTCDVYGGSFSGYYWNWIRQPPGKGLEWIGEINHSGIT NYNPSLKSRVTISVDTSKNQFSLKLSSVTAADTAVYYCARGYCRSTTCYFDYWGQGT LVTVSS (495) |
| 17E9 VL | DIQMTQSPSSLSASVGDRVTITCRASQGISNDLAWYQQKPGKAPKRLIFAASSLQSGV PSRFSGSGSGTEFTLTISSLQPEDFATYYCLQHNSYPPTFGGGTKVEIK (493) |
| 17E9 VH | QVQLVESGGGVVQPGRSLRLSCAASGFTLSSYGMHWVRQAPGKGLEWVAVMSYDG NNKLYADSVKGRFTISRDNSKKTLYLQMNSLRAEDTAVYYCARDETETLYYYGIDVW GQGTTVTVSS (497) |
| 53D3 VL | DIVMTQSPLSLPVTPGEPASISCRSSQSLLYSNGYNYLDWYLQKPGQSPQLLIYLGSS RASGVPDRFSGSGSGTDFTLKISRVEAEDVGVYYCMQPLQTPLTFGGGTKVEIK (866) |
| 53D3 VH | EVQLVESGGGLVKPGGSLRLSCAASEFTFSTYYMSWVRQAPGKGLEWVSSISSSSSF IYYADSVKGRFTISRDNAKNSLYLQMNSLRAEDTAVYYCARDRIAAPGTYYYYGMDVW GQGTTVTVSS (868) |
| 54E5 VL | DIVMTQSPDSLAVSLGERATINCKSSQNILYSSNNKNYLAWYQQKPGQPPSLLIYWAS TRESGVPDRFSGSGSGTDFILTLSSLQAEDVAVYFCQQYYSIPWTFGQGTKVEIK (870) |
| 54E5 VH | QVQLVESGGGVVQPGRSLRLSCAASGFTFSTYGMHWVRQAPGKGLEWVAVIWYDG SNKDYADSVKGRFTVSRDNSRDTLYLQMNSLRAEDTAVYYCAREERDSYYHYGMDV WGQGTTVTVSS (872) |
| 56E1 VL | DIVMTQSPDSLIVSLGEGATINCKSSQSVLYSSNNKNYLAWYQQKPGQPPSLLIYWAS TRESGVPDRFSGSGSGTDFILTISSLQAEDVAVYYCQQYYSIPWTFGQGTKVEIK (874) |
| 56E1 VH | QVQLVESGGGVVQPGRSLRLSCAASGFIFSSYGMHWVRQAPGKGLEWVAVIWYDGS NKDYADSVKGRFTVSRDNSRDTLYLQMNSLRAEDTAVYYCAREERDSYYHYGMDVW GQGTTVTVSS (876) |
| 57A8VL | QSVLTQPPSVSGAPGQRVTISCIGSSSNIGAGYNVHWYQQLPGTAPKLLIYGNNNRP SGVPDRFSGSKSGTSASLAITGLQTEDEADYYCQSYDSSLSGWVFGGGTKLTVL (878) |
| 57A8VH | EIQLLESGGGLVQPGGSLRLSCVASGFTFSSYVMSWVRQAPGKGLEWVSVISGSGG STYYADSVKGRFTISRDNSKTTLYLQMNSLRAEDTAVYYCAKGGTNYYYYYSGMDVW GQGTTVTVSS (880) |
| 58G5VL | QSVLTQPPSVSGAPGQRVTISCIGSSSNIGAGYDVHWYQQLPGTAPKLLIYGNSHRP SGVPDRFSGSKSGTSASLAITGLQAEDEADYYCQSYDSSLSGYVFGTGTKVTVL (882) |
| 58G5VH | EVQLLESGGGLVQPGGSLRLSCAASGFTFSNYAMSWVRQAPGKGLQWVSVISGRGG STYYADSVKGRFTISRDNSKNTLYLQMNSLRAEDTAVYYCAKDGYSSAWYFDYWGQ GTLVTVSS (884) |
| 60G11VL | QSVLTQPPSVSGAPGQRVTISCTGSGSNIGAGYDVHWYQQLPGTAPKLLIYGNSHRP SGIPDRFSGSKSGTSASLAITGLQAEDEADYYCQSYDSSLSGYVFGTGTKVTVL (886) |
| 60G11VH | EVQLLESGGGLVQPGGSLRLSCAASGFTFSNYAMNWVRQAPGKGLEWVSVISGRGG STYYADSVKGRFTISRDNSRNTLYLQMNSLRAEDTAIYYCAKDGYSSAWFFDYWGQG TLITVSS (888) |
| 73C2VL | DIQMTQSPSSLSASVGDRVTITCRASQSFSSYLNWYQQKPGKAPELLIYAASSLQSGV PSRFSGSGSGTDFTLTISSLQPEDFASYFCQQSYSTPRSFGQGTKLEIK (890) |

TABLE D-continued

Variable domain sequences of preferred anti-TL1A antibodies

| Antibody designation | Amino acid sequence (SEQ ID NO) |
|---|---|
| 73C2VH | QVQLQQSGPGLVKPSQTLSLTCAISGDSVSSSATWNWIRQSPSRGLEWLGRTYQR SKWNNDYAVSVKSRITINPDTSRNQFSLQLNSVTPEDTAVYYCAREVVAGPRWFDPW GQGTLVTVSS (892) |
| 76A4VL | DIQMTQSPSSLSASVGDRVTITCRASQSVTSYLNWYQQKPGKAPKLLIYTASSLQSGIP SRFSGSGSGTDFTLTISSLQPEDFATYFCQQSYSTPRSFGQGTKLEIK (894) |
| 76A4VH | QVQLQQSGPGLVKPSQTLSLTCAISGDSVSSNSATWNWIRQSPSRGLEWLGRTYYR SKLYNDYAVSVKSRITINPDTSKNQFSLQLNSVTPEDTAVYYCAREVVAGPRWFDPW GQGTLVTVSS (896) |
| 77D12VL | QSVLTQPPSASGTPGQRVTISCSESNSDIGTNAVNWYQQFPGTAPKFLIYSNNKRPSG VPDRFSGSKSGTSASLAISGLQSEDEADYYCATWDDNLNGPLFGGGTKLTVL (898) |
| 77D12VH | QVQLVQSGAEVKKPGASVRVSCKASGYTFTGFYMHWVRQAPGQGLEWMGWINPDS GGTNYAQKFQGRVTMTRDTSISTAYMELSRLRSDDTAVYYCAREGIAVALTYWGQGT LVTVSS (900) |
| 87H11VL | DIQMTQSPSSLSASVGDRVTITCRASQSISSYLNWYQQKPGKAPKLLIYVASSLQSGV PSRFSGSGSGTDFTLTISSLQPEDFATYYCQQSYSNPQECSFGQGTKLEIK (902) |
| 87H11VH | QEQLQQWGAGLLKPSETLSLTCAVYGGSFSGYYWSWIRQPPGKGLEWIGEINHSGR TNYNPSLKSRVTISVDTSKNQFSLKLSSVTAADTAVYYCARDSGWHFSFDIWDQGTM VTVSS (904) |
| 88H9VL | DIQMTQSPSSLSASVGDRVTITCRASQGIRNDLGWYQEKPGKAPKRLIYAASGLQGG DPSRFSGSGSGTEFTLTISSLQPEDFATYYCLQHNSYPTWTFGQGTKVEIK (906) |
| 88H9VH | QVQLVESGAGVVQPGRSLRLSCAASGFTFSSYGMHWVRQAPGMGLEWVAVIWFDG SNEYYADSVKGRFTISRDNSKNTLYLQMNSLRAEDTAVYYCARERWFGELLDYWGQ GTLVTVSS (908) |
| 89H9VL | DIQMIQSPSSLSASVGDRVTITCRASQSISYYLNWYQQKPGKAPKFLIYAASSLQSGVP SRFSGSGSGTDFTLTISSLQPEDFATYYCQQSYSSITFGQGTRLEIK (910) |
| 89H9VH | EVHLLESGGGLVQPGGSLRLSCAASGFTFSSYAMSWVRQAPGKGLEWVSGISGGGG STYYADSVKGRFTISRDNSKNTLYLQMNSLRAENTAVYYCAIEMAGAFDIWGQGTMVT VSS (912) |
| 91D7VL | DIQMTQSPSSLSASVGDRVTITCRASQNISSYLNWYQQRPGKAPNLLLFTASSLQSGV PSRFSGSGSGTDFTLTINSLQPEDFATYYCQQSYSNPPESSFGQGTKLEIK (914) |
| 91D7VH | QVQLQQWGAGLLKPSETLSLTCAVYGGSFSGYYWSWIRQPPGKGLEWIGEINPVGR TNYKPSLKSRVTISVDTSKNQFSLKLSSVTAADTALYYCARDNGWHYAFDIWGQGTM VTVSS (916) |
| 91F10_LC1VL | DVVMTQSPLSLPVTLGQPASISCRSSQSLVYSDGNTYLNWFQQRPGRSPRRLIYKVS NWDSGVPDRFSGSGSGTDSTLIISRVEAEDVGVYYYMQGTHWPLGGGTKVEIK (918) |
| 91F10_LC1VH | QGQLVQSGAEVKKPGASVKVSCQASGYTFTAYYMHWVRQAPGQGLEWMGWINPNS GGTNYAQKFRGRVTMTRDTSISTAYMELSRLRSDDTAVYYCATGGSWEGFDYWGQ GTLVTVSS (920) |
| 91F10_LC2VL | DIQMTQSPSSLSASVGDRVTITCRASQSISSYLNWYQQKPGKAPKFLIYAASRLQSGV PSRFSGSGSGTDFTLTISSLQPEDFATYYCQQSDSTPITFGQGTRLEIK (922) |
| 91F10_LC2VH | QGQLVQSGAEVKKPGASVKVSCQASGYTFTAYYMHWVRQAPGQGLEWMGWINPNS GGTNYAQKFRGRVTMTRDTSISTAYMELSRLRSDDTAVYYCATGGSWEGFDYWGQ GTLVTVSS (920) |
| 91G8VL | DIQMIQSPSSLSASVGDRVTITCRASQSISSYLNWYQQKPGKAPKFLIYAASSLQSGVP SRFSGSGSGTDFTLTISSLQPEDFATYYCQQSFSTITFGQGTRLEIK (924) |
| 91G8VH | EVQLLESGGGLVQPGGSLRLSCVASGFTFSSYAMSWVRQAPGKGLEWVSGISGSGG SRYYADSVKGRFTISRDNSKNTLYLQMNSLRAEDTAVYYCAIEVAGAFDIWGQGTMVT VSS (926) |
| 92D3VL | DIQMTQSPSSLSASVGDRVTITCRASQSISSYLNWYQQKPGTAPKFLIYGASRLQSGV PSRFSGSGSGTDFTLTISSLQPEDFATYYCQQSDTTPITFGQGTRLEIK (928) |
| 92D3VH | QVQLVQSGAEVKKPGASVQVSCKASGYTFTGYYMHWIRQAPGQGLEWLGWIIPNSG GTNYAQKFQGRVTMTRDTSISTAYMELSRLRSDDTAVYYCATGSSWEGFDYWGQGT LVTVSS (930) |

TABLE D-continued

Variable domain sequences of preferred anti-TL1A antibodies

| Antibody designation | Amino acid sequence (SEQ ID NO) |
|---|---|
| 92E5VL | DIQMIQSPSSLSASVGDRVTITCRASQSISHYLNWYQQKPGKAPKFLIYAASSLQSGVP SRFSGSGSGTDFTLTISSLQPEDFATYYCQQSFSSITFGQGTRLEIK (932) |
| 92E5VH | EVHLLESGGGLVQPGGSLRLSCAASGFTFSSYAMSWVRQVPGKGLEWVSGISGRGG STYYADSVKGRFTISRDNSKNTLYLQMDSLRAEDTAVYNCAIEVAGAFDIWGQGTMVT VSS (934) |

Each of the foregoing polypeptides is encoded by a nucleic acid having the nucleotide sequence immediately preceding the polypeptide sequence in the Sequence Listing. The sequences from antibodies 9C8 and 3B3 are preferred.

The full anti-TL1A antibody sequences shown in Table E are preferred for the anti-TL1A antibodies. LC refers to the antibody light chain, HC to the heavy chain. Also encompassed within the invention are molecules having at least 90% sequence identity with either or both of the light chain and heavy chain sequences in Table E.

TABLE E

Preferred anti-TL1A Antibodies

| Antibody designation | Light chain SEQ ID NO | Heavy chain SEQ ID NO | iPS (molecule designation) |
|---|---|---|---|
| 3C6 | 50 | 52 | 284112 |
| 2G11 | 54 | 56 | 285396 |
| 9C8 | 58 | 60 | 285412 |
| 23B3 | 62 | 64 | 290043 |
| 3B3 | 66 | 68 | 308844 |
| 23B3 HC4 | 70 | 72 | 325246 |
| 23B3 HC3 | 74 | 76 | 325336 |
| 5G4 | 455 | 457 | 284510 |
| 17E9 | 459 | 461 | 284078 |
| 88H9 | 1116 | 1118 | 427485 |
| 54E5 | 1120 | 1122 | 427576 |
| 60G11 | 1124 | 1126 | 427493 |
| 53D3 | 1128 | 1130 | 427504 |
| 89H9 | 1132 | 1134 | 427509 |
| 91D7 | 1136 | 1138 | 427514 |
| 57A8 | 1140 | 1142 | 427519 |
| 91G8 | 1144 | 1146 | 427524 |
| 76A4 | 1148 | 1150 | 427529 |
| 87H11 | 1152 | 1154 | 427534 |
| 58G5 | 1156 | 1158 | 427539 |
| 57A8 | 1160 | 1162 | 427519 |
| 73C2 | 1164 | 1166 | 427544 |
| 77D12 | 1168 | 1170 | 427549 |
| 56E1 | 1172 | 1174 | 427554 |
| 92E5 | 1176 | 1178 | 427559 |
| 92D3 | 1180 | 1182 | 427564 |
| 91F10_LC1 | 1184 | 1186 | 427580 |
| 91F10_LC2 | 1188 | 1190 | 427572 |

Each of the amino acid sequences in Table E is encoded by the nucleic acid sequence immediately preceding it in the Sequence Listing. The sequences from antibodies 9C8 and 3B3 are preferred.

The foregoing anti-TL1A antibody sequences can be used in bispecific antigen proteins in any of the formats described herein. Preferably, such sequences are used in hetero Ig antigen binding proteins and IgG-scFv bispecific antigen binding proteins as described in this specification.

Hetero Ig Bispecific Antigen Binding Proteins

The invention further relates to hetero Ig bispecific antigen binding proteins as shown in FIG. 1 that comprise TL1A-specific binding entities. Structurally, hetero Ig bispecific antigen binding proteins comprise:

(a) a TL1A binding entity light chain variable domain comprised in a light chain separate from a TL1A binding entity heavy chain variable domain, a heavy chain variable domain directed to a different antigen (e.g., TNF-α), and a binding entity light chain variable domain directed to the different antigen;

(b) a TL1A binding entity heavy chain variable domain comprised in a heavy chain separate from the TL1A binding entity light chain variable domain, the heavy chain variable domain directed to a different antigen, and the light chain variable domain directed to a different antigen;

(c) the heavy chain variable domain directed to a different antigen comprised in a heavy chain separate from the light chain domain directed to said different antigen, the TL1A binding entity heavy chain variable domain, and the TL1A binding entity light chain variable domain;

(d) the heavy chain comprising the TL1A binding entity heavy chain variable domain covalently bound to the light chain comprising the TL1A binding entity light chain variable domain;

(e) the heavy chain comprising the heavy chain variable domain directed to said different antigen covalently bound to the light chain comprising light chain variable domain directed to the different antigen; and (f) the heavy chain comprising the TL1A binding entity heavy chain variable domain covalently bound to the heavy chain comprising the heavy chain variable domain directed to the different antigen.

For such hetero Ig bispecific antibodies, the TL1A-specific binding entities are preferred to comprise one or more of the CDRs listed in Table A. The variable region domains in Table D may be employed but it is preferred that the TL1A binding entity comprise charged amino acids that aid in correct assembly of the hetero Ig bispecific antigen binding protein (see FIG. 1). Variable region sequences preferred for the hetero Ig bispecific antibodies are shown in Table F. As before, VL in Table F refers to the light chain variable region, VH to the heavy chain variable region. The SEQ ID NO from the Sequence Listing appears after each sequence in Table F.

TABLE F

Hetero Ig TL1A-specific variable regions

| Antibody designation | Amino acid sequence (SEQ ID NO) |
|---|---|
| 3B3 variant VL | EIVLTQSPGTLSLSPGERATLSCRASQSVRSSYLAWYQQKPGQAPRLLIYGASSRATG IPDRFSGSGSGTDFTLTISRLEPEDFAVYYCQQYGSSPTFGQGTRLEIK (288) |
| 3B3 variant VH | QVQLQQWGAGLLKPSETLSLTCAVHGGSFSGYYWNWIRQPPGKGLEWIGEINHAGIT NYNPSLKSRVTISLDTSKNQFSLKLTSVTAADTAVYYCARGYCRSTTCYFDYWGQGTL VTVSS (290) |
| 2G11 variant VL | DIQMTQSPSSLSASVGDRVTITCRASQSINNYLNWYQQKPGKAPKLLIYATSSLQSGV PSRFSGSGSGTDFSLTISSLQPEDFATYFCQQSYSTPRTFGQGTKVEIK (292) |
| 2G11 variant VH | QVQLQESGPGLVKPSETLSLTCTVSGGSISSYFWSWIRQPPGKGLEWIGYIYYSGSTN YNPSLKSRVTMSIDTSKNQFSLKLSSVTAADTAVYYCAREIGSYYGFDYWGQGTLVTV SS (294) |
| 23B3 VH4 VL | DIQMTQSPSSLSASVGDRVTITCRSSQSVLYSSNNKNYLVWYQQKPGKVPKLLIYWAS TRESGVPSRFSGSGSGTDFTLTISSLQPEDVATYYCQQYYKTPLTFGGGTKVEIK (296) |
| 23B3 VH4 VH | QVQLQESGPGLVKPSETLSLTCTISGDSVSTNSVAWNWIRQPPGKGLEWIGRTYYRS KWYNDYAVSLKSRVTISPDTSKNQFSLKLSSVTAADTAVYYCAREDGDSYYRYGMDV WGQGTTVTVSS (298) |
| 23B3 VH3 VL | DIQMTQSPSSLSASVGDRVTITCRSSQSVLYSSNNKNYLVWYQQKPGKVPKLLIYWAS TRESGVPSRFSGSGSGTDFTLTISSLQPEDFATYYCQQYYKTPLTFGGGTKVEIK (300) |
| 23B3 VH3 VH | EVQLLESGGGLVQPGGSLRLSCAISGDSVSTNSVAWNWIRQAPGKGLEWVSRTYYR SKWYNDYAVSVKGRFTISPDTSKNTFYLQMNSLRAEDTAVYYCAREDGDSYYRYGM DVWGQGTTVTVSS (302) |
| 3C6 variant VL | DIQMTQSPSSLSASVGDRVTITCRTSQDIRDDLGWYQQKPGKAPKLLIYDASSLQSGV PSRFSGSGSGTEFTLTISSLQPEDFATYYCLQHNSYPPTFGQGTKVEIK (304) |
| 3C6 variant VH | QVQLVESGGGVVQPGRSLRLSCAASGFTFSSYGMHWVRQAPGKGLEWVAVISYDG NNKLYTDSVKGRFTISRDDSKSTLYLQMNSLRAEDTAVYYCARDPTVTLYYYYGMDV WGQGTTVTVSS (306) |
| 3C6 VL | DIQMTQSPSSLSASVGDRVTITCRTSQDIRDDLGWYQQKPGKAPKRLIYDASSLQSGV PSRFSGSGSGTEFTLTISSLQPEDFATYYCLQHNSYPPTFGQGTKVEIK (308) |
| 3C6 VH | QVQLVESGGGVVQPGRSLRLSCAASGFTFSSYGMHWVRQAPGKGLEWVAVISYDG NNKLYTDSVKGRFTISRDDSKSTLYLQMNSLRAEDTAVYYCARDPTVTLYYYYGMDV WGQGTTVTVSS (310) |

Each of the polypeptides in Table F is encoded by a nucleic acid having the sequence immediately preceding the polypeptide sequence in the Sequence Listing.

Within the scope of this invention are hetero IgG molecules with a TNF-specific binding entity, preferably together with a TL1A-specific binding entity. The TNF-specific binding entity preferably comprises one or more sequences of CDRs or variable domains of antibodies 3.2 (described hereinafter), 234 (described hereinafter), certolizumab, adalimumab, infliximab, golimumab, and the antibodies disclosed in U.S. Pat. No. 7,285,269, which is hereby incorporated by reference. Throughout this specification, "certolizumab" refers to an antibody having variable region sequences derived from certolizumab pegol. Preferred sequences based on such CDRs are shown in Table G.

TABLE G

Preferred CDR sequences from anti-TNF-α antibodies

| Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| adalimumab | RASQGIRN YLA (92) | AASTLQS (242) | QRYNRAPY T (96) | DYAMH (158) | AITWNSGH IDYADSVE G (160) | VSYLSTAS SLDY (162) |
| certolizumab | KASQNVGT NVA (152) | SASFLYS (154) | QQYNIYPL T (156) | DYGMN (218) | WINTYIGEP IYADSVKG (220) | GYRSYAM DY (222) |

TABLE G-continued

Preferred CDR sequences from anti-TNF-α antibodies

| Antibody designation | LCDR1 (SEQ ID NO) | LCDR2 (SEQ ID NO) | LCDR3 (SEQ ID NO) | HCDR1 (SEQ ID NO) | HCDR2 (SEQ ID NO) | HCDR3 (SEQ ID NO) |
|---|---|---|---|---|---|---|
| C234 | RASQDIRN DLG (140) | AASSLQS (112) | LQHNSYPL T (144) | SYDMH (206) | VISYDGSIK YYADSVKG (208) | EVRSGSYY YYYSMDV (210) |
| 3.2 | TGSSSNIG AGYDVH (146) | GNSNRPS (148) | QSYDSSLS GSV (150) | SYWIG (212) | IIYLGDSDT RYSPSFQG (214) | SNWGLDY (216) |

Each of the polypeptides in Table G is encoded by a nucleic acid having the sequence immediately preceding the sequence of the polypeptide in the Sequence Listing. The sequences in Table G may be used in any bispecific antigen binding protein format, preferably a hetero Ig or IgG-scFv format and preferably together with a TL1A antigen binding entity.

The TNF binding entities of the bispecific antigen binding proteins more preferably comprise the sequences of the variable region of selected anti-TNF antibodies. The sequences of such variable regions are set forth in Table H. As before, VL refers to the variable region of the light chain and VH refers to the variable region of the heavy chain. The invention further encompasses molecules having sequences at least about 90% identical to any of the sequences shown in Table H.

TABLE H

Variable domain sequences of preferred anti-TNF-α antibodies

| Source Antibody designation | Amino acid sequence (SEQ ID NO) |
|---|---|
| adalimumab VL | DIQMTQSPSSLSASVGDRVTITCRASQGIRNYLAWYQQKPGKAPKLLIYAASTLQSGV PSRFSGSGSGTDFTLTISSLQPEDVATYYCQRYNRAPYTFGQGTKVEIK (2) |
| adalimumab VH | EVQLVESGGGLVQPGRSLRLSCAASGFTFDDYAMHWVRQAPGKGLEWVSAITWNS GHIDYADSVEGRFTISRDNAKNSLYLQMNSLRAEDTAVYYCAKVSYLSTASSLDYWG QGTLVTVSS (4) |
| certolizumab VL | DIQMTQSPSSLSASVGDRVTITCKASQNVGINVAWYQQKPGKAPKALIYSASFLYSGV PYRFSGSGSGTDFTLTISSLQPEDFATYYCQQYNIYPLTFGQGTKVEIK (42) |
| certolizumab VH | EVQLVESGGGLVQPGGSLRLSCAASGYVFTDYGMNWVRQAPGKGLEWMGWINTYI GEPIYADSVKGRFTFSLDTSKSTAYLQMNSLRAEDTAVYYCARGYRSYAMDYWGQG TLVTVSS (44) |
| certolizumab variant VL | DIQMTQSPSSLSASVGDRVTITCKASQNVGTNVAWYQQKPGKAPKALIYSASFLYSGV PYRFSGSGSGTDFTLTISSLQPEDFATYYCQQYNIYPLTFGQGTKVEIK (42) |
| certolizumab variant VH | EVQLVESGGGLVQPGGSLRLSCAASGYVFTDYGMNWVRQAPGKGLEWMGWINTYI GEPIYADSVKGRFTISLDTSKSTAYLQMNSLRAEDTAVYYCARGYRSYAMDYWGQGT LVTVSS (318) |
| 3.2 VL | QSVLTQPPSVSGAPGQRVTISCIGSSSNIGAGYDVHWYQQFPGTAPKLLIQGNSNRP SGVPDRFSGSKSGTSASLAITGLQAEDEADYYCQSYDSSLSGSVFGGGTKLTVL (38) |
| 3.2 VH | EVQLVQSGAEVKKPGESLKISCKTSEYSFTSYWIGWVRQMPGKGLEWMGIIYLGDSD TRYSPSFQGQVTISADKSISTAYLQWSSLKASDTAMYYCARSNWGLDYWGQGTLVTV SS (40) |

TABLE H-continued

Variable domain sequences of preferred anti-TNF-α antibodies

| Source Antibody designation | Amino acid sequence (SEQ ID NO) |
|---|---|
| C234 VL | DIQMTQSPSSLSASVGDRVTITCRASQDIRNDLGWYQQKPGKAPKRLIYAASSLQSGV PSRFSGSGSGPEFTLTISSLQPEDFATYYCLQHNSYPLTFGGGTKVEIK (34) |
| C234 VH | QVQLVESGGGVVQPGRSLRLSCAASGFTFSSYDMHWVRQAPGKGLEWVAVISYDGS IKYYADSVKGRFTISRDNSKNTLYLQVNSLRAEDTAVYYCAREVRSGSYYYYYSMDV WGQGTTVTVSS (36) |

Each of the foregoing polypeptides is encoded by a nucleic acid having the nucleotide sequence immediately preceding the polypeptide sequence in the Sequence Listing.

Preferred anti-TL1A/anti-TNF hetero IgG bispecific antibodies are shown in Table I. The hetero Ig molecule designation is based on the foregoing designations for the parental antibodies used to construct the hetero Ig molecule. The molecule designated "certolizumab/3B3 variant," for example, employs polypeptides having the sequences from antibodies designated certolizumab and 3B3 variant herein. As before, VL refers to the variable region of the light chain, VH to the variable region of the heavy chain. Such molecules may include a "C clamp," cysteine molecules substituted into the sequences to provide an additional disulfide bond for stabilization. Such cysteine substitutions are preferably introduced at the VL-VH interface, at positions 44 in the VH and 100 in the VL in the Kabat numbering scheme. Additional substitutions may be made for stability or to introduce other functionality. Embodiments of the invention include molecules with at least 90% sequence identity to any of the sequences shown in Table I.

TABLE I

Variable region sequences of anti-TL1A/anti-TNF-α hetero IgG molecules

| Hetero Ig molecule designation | Anti-TNF-α binding entity | | Anti-TL1A binding entity | |
|---|---|---|---|---|
| | VL SEQ ID NO | VH SEQ ID NO | VL SEQ ID NO | VH SEQ ID NO |
| Certolizumab/ 3B3 variant | 42 | 286 | 288 | 290 |
| Certolizumab/ 2G11 variant | 42 | 44 | 292 | 294 |
| Certolizumab/ 23B3 VH4 | 42 | 44 | 296 | 298 |
| Certolizumab/ 23B3 VH3 | 42 | 44 | 300 | 302 |
| Certolizumab/ 3C6 variant | 42 | 44 | 304 | 306 |
| Certolizumab/ 3C6 | 42 | 44 | 308 | 310 |
| 3.2/ 3B3 variant | 312 | 314 | 288 | 290 |
| 3.2/ 2G11 variant | 312 | 314 | 292 | 294 |
| 3.2/ 23B3 VH4 | 312 | 314 | 296 | 298 |
| 3.2/ 23B3 VH3 | 312 | 314 | 300 | 302 |
| 3.2/ 3C6 variant | 312 | 314 | 304 | 306 |
| 3.2/ 3C6 | 312 | 314 | 308 | 310 |

TABLE I-continued

Variable region sequences of anti-TL1A/anti-TNF-α hetero IgG molecules

| Hetero Ig molecule designation | Anti-TNF-α binding entity | | Anti-TL1A binding entity | |
|---|---|---|---|---|
| | VL SEQ ID NO | VH SEQ ID NO | VL SEQ ID NO | VH SEQ ID NO |
| Certolizumab variant/ 3B3 variant | 42 | 318 | 288 | 290 |
| Certolizumab variant/ 2G11 variant | 42 | 318 | 292 | 294 |
| Certolizumab variant/ 23B3 VH4 | 42 | 318 | 296 | 298 |
| Certolizumab variant/ 3C6 variant | 42 | 318 | 304 | 306 |
| Certolizumab variant/ 3C6 | 42 | 318 | 308 | 310 |
| C234/ 3B3 variant | 320 | 322 | 288 | 290 |
| C234/ 2G11 variant | 320 | 322 | 292 | 294 |
| C234/ 23B3 VH4 | 320 | 322 | 31 | 298 |
| C234/ 23B3 VH3 | 320 | 322 | 300 | 302 |
| C234/ 3C6 variant | 320 | 322 | 304 | 306 |
| C234/ 3C6 | 320 | 322 | 308 | 310 |

Each of the foregoing polypeptides is encoded by a nucleic acid having the nucleotide sequence immediately preceding the amino acid sequence of the polypeptide in the Sequence Listing.

Table J lists the full light chain and heavy chain sequences of preferred hetero Ig bispecific antigen binding proteins in accordance with this invention. The listed sequences are preferred for all hetero Ig molecules, whether or not in the listed combination. The listed combinations are further preferred. "Var" in the molecule designation refers to variant. Such molecules may include charge variants to aid in assembly, as described for example in WO 2009/089004, published 16 Jul. 2009, hereby incorporated by reference.

TABLE J

Full sequences of anti-TL1A/anti-TNF-α hetero IgG molecules

| Hetero Ig molecule designation | Anti-TNF-α binding entity Light chain SEQ ID NO | Anti-TNF-α binding entity Heavy chain SEQ ID NO | Anti-TL1A binding entity Light chain SEQ ID NO | Anti-TL1A binding entity Heavy chain SEQ ID NO | Molecule designation (iPS no.) |
|---|---|---|---|---|---|
| certolizumab/3B3 var | 132 | 136 | 134 | 130 | 340593 |
| certolizumab/2G11 var | 132 | 136 | 239 | 138 | 340595 |
| certolizumab/23B3 VH4 | 132 | 136 | 253 | 323 | 340596 |
| certolizumab/23B3 VH3 | 132 | 136 | 327 | 325 | 340597 |
| certolizumab/3C6 var | 132 | 136 | 331 | 329 | 340598 |
| certolizumab/3C6 | 132 | 136 | 335 | 329 | 340599 |
| 3.2/3B3 var | 337 | 339 | 134 | 130 | 340601 |
| 3.2/2G11 var | 337 | 339 | 239 | 138 | 340602 |
| 3.2/23B3 VH4 | 337 | 339 | 323 | 253 | 340603 |
| 3.2/23B3 VH3 | 337 | 339 | 327 | 325 | 340604 |
| 3.2/3C6 var | 337 | 339 | 331 | 329 | 340605 |
| 3.2/3C6 | 337 | 339 | 335 | 329 | 340606 |
| certolizumab var/3B3 var | 132 | 316 | 134 | 130 | 340607 |
| certolizumab var/2G11 var | 132 | 316 | 239 | 138 | 340608 |
| certolizumab var/23B3 VH4 | 132 | 316 | 323 | 253 | 340609 |
| certolizumab var/3C6 var | 132 | 316 | 335 | 329 | 340611 |
| certolizumab var/3C6 | 132 | 316 | 331 | 329 | 340610 |
| certolizumab var/3B3 var | 333 | 316 | 134 | 130 | 340612 |
| certolizumab var/2G11 var | 333 | 316 | 239 | 138 | 340613 |
| certolizumab var/23B3 VH4 | 333 | 316 | 323 | 253 | 340614 |
| certolizumab var/3C6 var | 333 | 316 | 331 | 329 | 340615 |
| certolizumab var/3C6 | 333 | 316 | 335 | 329 | 340616 |
| certolizumab var/3B3 var | 333 | 463 | 134 | 130 | 340617 |
| Certolizumab var/2G11 var | 333 | 463 | 239 | 138 | 340618 |
| Certolizumab var/23B3 VH4 | 333 | 463 | 323 | 253 | 340619 |
| certolizumab var/3C6 var | 333 | 463 | 331 | 329 | 340620 |
| certolizumab var/3C6 | 333 | 463 | 335 | 329 | 340621 |
| C234/3B3 var | 341 | 343 | 134 | 130 | 349421 |
| C234/2G11 var | 341 | 343 | 239 | 138 | 349425 |
| C234/23B3 VH4 | 341 | 343 | 323 | 253 | 349428 |
| C234/23B3 VH3 | 341 | 343 | 327 | 325 | 349431 |
| C234/3C6 var | 341 | 343 | 331 | 329 | 349433 |
| C234/3C6 | 341 | 343 | 335 | 329 | 349435 |
| certolizumab/3B3 var | 510 | 514 | 512 | 555 | 349437 |
| certolizumab/2G11 var | 510 | 514 | 541 | 558 | 349439 |
| certolizumab/23B3 VH4 | 510 | 514 | 539 | 562 | 349441 |
| certolizumab/23B3 VH3 | 510 | 514 | 543 | 565 | 349443 |
| Certolizumab/3C6 var | 510 | 514 | 543 | 568 | 349445 |
| Certolizumab/3C6 | 510 | 514 | 544 | 568 | 349448 |
| 3.2/3B3 var | 542 | 571 | 512 | 555 | 349451 |
| 3.2/2G11 var | 542 | 571 | 541 | 558 | 349453 |
| 3.2/23B3 VH4 | 542 | 571 | 539 | 562 | 349455 |
| 3.2/23B3 VH3 | 542 | 571 | 543 | 565 | 349456 |
| 3.2/3C6 var | 542 | 571 | 543 | 568 | 349457 |
| 3.2/3C6 | 542 | 571 | 544 | 568 | 349458 |
| Certolizumab var/3B3 var | 510 | 573 | 512 | 555 | 349460 |
| Certolizumab var/2G11 var | 510 | 573 | 541 | 558 | 349461 |
| Certolizumab var/23B3 VH4 | 510 | 573 | 539 | 562 | 349463 |
| Certolizumab var/3C6 var | 510 | 573 | 543 | 568 | 349465 |
| Certolizumab var/3C6 | 510 | 573 | 544 | 568 | 349467 |
| Certolizumab var/3B3 var | 540 | 573 | 512 | 555 | 349468 |
| Certolizumab var/2G11 var | 540 | 573 | 541 | 558 | 349470 |
| Certolizumab var/23B3 VH4 | 540 | 573 | 539 | 562 | 349471 |
| Certolizumab var/3C6 var | 540 | 573 | 543 | 568 | 349473 |
| Certolizumab var/3C6 | 540 | 573 | 544 | 568 | 349474 |
| Certolizumab var/3B3 var | 540 | 487 | 512 | 555 | 349476 |
| Certolizumab var/2G11 var | 540 | 487 | 541 | 558 | 349479 |
| Certolizumab var/23B3 VH4 | 540 | 487 | 539 | 562 | 349480 |
| Certolizumab var/3C6 var | 540 | 487 | 543 | 568 | 349482 |
| Certolizumab var/3C6 | 540 | 487 | 544 | 568 | 349484 |
| C234/3B3 var | 518 | 522 | 512 | 555 | 349485 |
| C234/2G11 var | 518 | 522 | 541 | 558 | 349486 |
| C234/23B3 VH4 | 518 | 522 | 539 | 562 | 349487 |
| C234/23B3 VH3 | 518 | 522 | 543 | 565 | 349488 |
| C234/3C6 var | 518 | 522 | 543 | 568 | 349489 |
| C234/3C6 | 518 | 522 | 544 | 568 | 349490 |
| Certolizumab/3B3 var | 545 | 578 | 546 | 579 | 349491 |
| Certolizumab/2G11 var | 545 | 578 | 548 | 582 | 349492 |
| Certolizumab/23B3 VH4 | 545 | 578 | 549 | 585 | 349493 |
| Certolizumab/23B3 VH3 | 545 | 578 | 550 | 588 | 349495 |

TABLE J-continued

Full sequences of anti-TL1A/anti-TNF-α hetero IgG molecules

| Hetero Ig molecule designation | Anti-TNF-α binding entity Light chain SEQ ID NO | Anti-TNF-α binding entity Heavy chain SEQ ID NO | Anti-TL1A binding entity Light chain SEQ ID NO | Anti-TL1A binding entity Heavy chain SEQ ID NO | Molecule designation (iPS no.) |
|---|---|---|---|---|---|
| Certolizumab/3C6 var | 545 | 578 | 551 | 591 | 349496 |
| Certolizumab/3C6 | 545 | 578 | 552 | 591 | 349498 |
| C234/3B3 var | 547 | 595 | 546 | 579 | 349499 |
| C234/2G11 var | 547 | 595 | 548 | 582 | 349501 |
| C234/23B3 VH4 | 547 | 595 | 549 | 585 | 349502 |
| C234/23B3 VH3 | 547 | 595 | 550 | 588 | 349503 |
| C234/3C6 var | 547 | 595 | 551 | 591 | 349504 |
| C234/3C6 | 547 | 595 | 552 | 591 | 349505 |
| Certolizumab/3B3 var | 132 | 599 | 134 | 598 | 349506 |
| Certolizumb/2G11 var | 132 | 599 | 239 | 601 | 349507 |
| Certolizumab/23B3 VH4 | 132 | 599 | 323 | 603 | 349508 |
| Certolizumab/23B3 VH3 | 132 | 599 | 327 | 605 | 349509 |
| Certolizumab/3C6 var | 132 | 599 | 331 | 607 | 349510 |
| Certolizumab/3C6 | 132 | 599 | 335 | 607 | 349511 |
| 3.2/3B3 var | 337 | 609 | 134 | 598 | 349512 |
| 3.2/2G11 var | 337 | 609 | 239 | 601 | 349513 |
| 3.2/23B3 VH4 | 337 | 609 | 323 | 603 | 349514 |
| 3.2/23B3 VH3 | 337 | 609 | 327 | 605 | 349515 |
| 3.2/3C6 variant | 337 | 609 | 331 | 607 | 349516 |
| 3.2/3C6 | 337 | 609 | 335 | 607 | 349517 |
| Certolizumab var/3B3 var | 132 | 611 | 134 | 598 | 349518 |
| Certolizumab var/2G11 var | 132 | 611 | 239 | 601 | 349519 |
| Certolizumab var/23B3 VH4 | 132 | 611 | 323 | 603 | 349520 |
| Certolizumab var/3C6 var | 132 | 611 | 331 | 607 | 349521 |
| Certolizumab var/3C6 | 132 | 611 | 335 | 607 | 349522 |
| Certolizumab var/3B3 var | 333 | 611 | 134 | 598 | 349523 |
| Certolizumab var/2G11 var | 333 | 611 | 239 | 601 | 349524 |
| Certolizumab var/23B3 VH4 | 333 | 611 | 323 | 603 | 349525 |
| Certolizumab var/3C6 var | 333 | 611 | 331 | 607 | 349526 |
| Certolizumab var/3C6 | 333 | 611 | 335 | 607 | 349527 |
| Certolizumab var/3B3 var | 333 | 613 | 134 | 598 | 349528 |
| Certolizumab var/2G11 var | 333 | 613 | 239 | 601 | 349529 |
| Certolizumab var/23B3 VH4 | 333 | 613 | 323 | 603 | 349530 |
| Certolizumab var/3C6 var | 333 | 613 | 335 | 607 | 349531 |
| C234/3B3 | 341 | 615 | 134 | 598 | 349532 |
| C234/2G11 var | 341 | 615 | 239 | 601 | 349533 |
| C234/23B3 VH4 | 341 | 615 | 323 | 603 | 349534 |
| C234/23B3 VH3 | 341 | 615 | 327 | 605 | 349535 |
| C234/3C6 var | 341 | 615 | 331 | 607 | 349536 |
| C234/3C6 | 341 | 615 | 335 | 607 | 349537 |
| Certolizumab var/3C6 var | 333 | 613 | 331 | 607 | 349539 |
| Certolizumab var/2G11 var | 132 | 463 | 239 | 138 | 361830 |
| Certolizumab var/3C6 var | 132 | 463 | 331 | 329 | 361831 |
| Certolizumab var/3C6 | 132 | 463 | 335 | 320 | 361832 |
| Certolizumab var/3B3 var | 510 | 487 | 512 | 555 | 361833 |
| Certolizumab var/2G11 var | 510 | 487 | 541 | 558 | 361834 |
| Certolizumab var/23B3 VH4 | 510 | 487 | 539 | 562 | 361835 |
| Certolizumab var/3C6 var | 510 | 487 | 543 | 568 | 361836 |
| Certolizumab var/3C6 | 510 | 487 | 544 | 568 | 361837 |
| Certolizumab var/3B3 var | 132 | 613 | 134 | 598 | 361838 |
| Certolizumab var/23B3 VH4 | 132 | 613 | 323 | 603 | 361839 |
| Certolizumab var/3C6 var | 132 | 613 | 331 | 607 | 361840 |
| Certolizumab var/3C6 | 132 | 613 | 335 | 607 | 361841 |
| Certolizumab var/3B3 var | 132 | 463 | 134 | 130 | 361842 |
| Certolizumab var/3B3 var | 540 | 616 | 512 | 508 | 381084 |
| Certolizumab var/3B3 var | 540 | 620 | 512 | 508 | 381089 |
| Certolizumab var/2G11 var | 540 | 616 | 541 | 558 | 381094 |
| Certolizumab var/2G11 var | 540 | 620 | 541 | 558 | 381096 |
| Certolizumab var/23B3 VH4 | 540 | 616 | 539 | 562 | 381098 |
| Certolizumab var/23B3 VH4 | 540 | 620 | 539 | 562 | 381100 |
| C234 var/3B3 var | 538 | 623 | 512 | 502 | 381102 |
| C234 var/3B3 var | 537 | 626 | 512 | 508 | 381109 |
| Certolizumab var/3B3 var | 546 | 514 | 194 | 535 | 381208 |
| Certolizumab var/3B3 var | 536 | 616 | 194 | 535 | 381216 |
| Certolizumab/3B3 var | 536 | 620 | 194 | 535 | 381220 |
| Certolizumab var/3B3 var | 546 | 487 | 194 | 535 | 381222 |
| Certolizumab/3B3 var | 471 | 136 | 473 | 198 | 381292 |
| Certolizumab var/3B3 var | 479 | 477 | 473 | 198 | 381300 |
| Certolizumab/3B3 var | 176 | 136 | 520 | 198 | 381306 |
| Certolizumab var/3B3 var | 475 | 477 | 520 | 198 | 381312 |

TABLE J-continued

Full sequences of anti-TL1A/anti-TNF-α hetero IgG molecules

| Hetero Ig molecule designation | Anti-TNF-α binding entity Light chain SEQ ID NO | Anti-TNF-α binding entity Heavy chain SEQ ID NO | Anti-TL1A binding entity Light chain SEQ ID NO | Anti-TL1A binding entity Heavy chain SEQ ID NO | Molecule designation (iPS no.) |
|---|---|---|---|---|---|
| Certolizumab var/3B3 var | 471 | 463 | 473 | 198 | 381316 |
| Certolizumab var/3B3 var | 176 | 463 | 570 | 198 | 381318 |
| Certolizumab var/3B3 var | 471 | 465 | 473 | 198 | 381320 |
| Certolizumab var/3B3 var | 176 | 465 | 520 | 198 | 381325 |
| certolizumab/3B3 variant | 510 | 514 | 512 | 508 | 376541 |
| C234/3B3 variant | 518 | 522 | 512 | 508 | 376542 |
| certolizumab/3B3 variant | 510 | 516 | 512 | 508 | 376543 |

Each of the foregoing polypeptides is encoded by a nucleic acid having the nucleotide sequence immediately preceding the amino acid sequence of the polypeptide in the Sequence Listing, except as noted in Table J-1.

TABLE J-1

Nucleic Acids Encoding Polypeptides of Table J

| Polypeptide SEQ ID NO: | Encoding Nucleic Acid SEQ ID NO: |
|---|---|
| 176 | 526 |
| 194 | 627 |
| 198 | 529 |
| 239 | 236 |
| 253 | 250 |
| 320 | 332 |
| 323 | 257 |
| 333 | 464 |
| 465 | 528 |
| 471 | 531 |
| 473 | 530 |
| 475 | 534 |
| 477 | 532 |
| 479 | 533 |
| 487 | 515 |
| 508 | 618 |
| 520 | 527 |
| 535 | 629 |
| 536 | 630 |
| 537 | 625 |
| 538 | 622 |
| 539 | 559 |
| 540 | 560 |
| 541 | 556 |
| 542 | 570 |
| 543 | 563 |
| 544 | 569 |
| 545 | 576 |
| 546 | 574, 628 |
| 547 | 593 |
| 548 | 580 |
| 549 | 583 |
| 550 | 587 |
| 551 | 590 |
| 552 | 592 |
| 570 | 527 |
| 571 | 553 |
| 579 | 575 |
| 588 | 586 |
| 591 | 589 |
| 598 | 596 |
| 599 | 597 |
| 616 | 617 |
| 623 | 621 |
| 626 | 624 |

IgG-scFv Bispecific Antigen Binding Proteins

IgG-scFv antigen binding proteins have the structure shown in FIG. 2. Such molecules comprise the heavy and light chains of an antibody (the IgG portion of the molecule), which comprises a first antigen binding entity of the IgG-scFv molecule. Such molecules further comprise an scFv—a fusion protein having in one chain the heavy chain variable domain and light chain variable domain of a second antibody. This scFv portion of the molecule comprises a second antigen binding entity of the IgG-scFv molecule. An scFv portion is fused to each heavy chain of the IgG portion of the molecule.

An IgG-scFv antigen binding protein herein comprises an anti-TL1A binding entity, particularly the amino acid sequences of anti-TL1A binding entities as described hereinabove. Preferred IgG-scFv antigen binding proteins comprise the sequences of anti-TL1A CDRs as described in Tables A, B and C, with those of Table A most preferred. More preferred IgG-scFv antigen binding proteins comprise the anti-TL1A variable domain sequences of Table D. Also preferred are IgG-scFv antigen binding proteins having the full antibody sequences of Table E.

This specification further relates to IgG-scFv molecules comprising an anti-TNF-α antigen binding entity, preferably comprising CDR sequences as described in Table G. Further preferred are IgG-scFv molecules comprising the sequences of anti-TNF-α variable domains as described in Table H. Further preferred are IgG-scFv molecules comprising the full amino acid sequences of anti-TNF-α antibodies as described in Table K.

TABLE K

Preferred anti-TNF-α Antibodies

| Antibody designation | Light chain SEQ ID NO | Heavy chain SEQ ID NO | iPS no. |
|---|---|---|---|
| Adalimumab | 46 | 48 | 104628 |
| C234 | 78 | 80 | 330194 |
| 3.2 | 84 | 86 | 330237 |
| certolizumab | 88 | 90 | 333788 |

Each of the amino acid sequences in Table K is encoded by the nucleic acid sequence immediately preceding it in the Sequence Listing.

In certain embodiments, the heavy chain of the IgG portion is fused to the scFv portion via a peptide linker. In certain embodiments, the peptide linker comprises a sequence selected from the group consisting of $(Gly_3Ser)_2$, $(Gly_4Ser)_2$, $(Gly_3Ser)_3$, $(Gly_4Ser)_3$, $(Gly_3Ser)_4$, $(Gly_4Ser)_4$, $(Gly_3Ser)_5$, $(Gly_4Ser)_5$, $(Gly_3Ser)_6$, and $(Gly_4Ser)_6$.

Further preferred are IgG-scFv antigen binding proteins having the heavy and light chain sequences as disclosed in Tables L and M. The heavy chain sequences in Tables L and M include the ScFv portion of the molecule fused to the heavy chain of the IgG portion of the molecule. In the molecule designation in the left column of these tables, the first antibody name identifies the IgG portion of the molecule, such that the IgG-scFv molecule comprises the full heavy and light chain sequences of the noted antibody. The second antibody name identifies the scFv portion of the molecule, such that the heavy chain sequence comprises the heavy chain variable domain and the light chain variable domain sequences as disclosed previously herein. Thus, "adalimumab IgG-9C8 scFv" includes the light chain of adalimumab and the heavy chain of adalimumab fused to heavy chain variable domain and light chain variable domain of antibody 9C8. "CC" in the molecule designations in Tables L and M refers to a cysteine clamp; molecules that include CC in their designation have been modified to have an additional cysteine disulfide bond. Such cysteine substitutions are preferably introduced at the VL-VH interface, at positions 44 in the VH and 100 in the VL in the Kabat numbering scheme. "Var" in Table L means variant.

TABLE L

Preferred TL1A binding entity IgG- TNF binding entity scFv antigen binding proteins

| Molecule designation | heavy chain SEQ ID NO | light chain SEQ ID NO | iPS |
|---|---|---|---|
| 9C8 IgG-adalimumab scFv | 355 | 447 | 370012 |
| 9C8 IgG-3.2 scFv | 357 | 447 | 370013 |
| 9C8 IgG-C234 scFv | 359 | 318 | 370014 |
| 9C8 IgG-adalimumab scFv + CC | 361 | 447 | 370015 |
| 9C8 IgG-3.2 scFv + CC | 363 | 447 | 370016 |
| 9C8 IgG-C234 scFv + CC | 365 | 58 | 370017 |
| 23B3 VH4 IgG-adalimumab scFv | 367 | 70 | 370018 |
| 23B3 VH4 IgG-3.2 scFv | 369 | 70 | 370019 |
| 23B3 VH4 IgG-C234 scFv | 371 | 70 | 370020 |
| 23B3 VH4 IgG-adalimumab scFV + CC | 373 | 70 | 370021 |
| 23B3 VH4 IgG-3.2 scFv + CC | 375 | 70 | 370022 |
| 23B3 VH4 IgG-C234 scFv + CC | 377 | 70 | 370023 |
| 3B3 var 2 IgG-adalimumab scFv | 391 | 523 | 371218 |
| 3B3v2 IgG-3.2 scFv | 393 | 523 | 371219 |
| 3Bv2 IgG-C234 scFv | 395 | 523 | 371220 |
| 3B3v2 IgG-adalimumab scFv + CC | 397 | 523 | 371221 |
| 3B3v2 IgG-3.2 scFv + CC | 399 | 523 | 371222 |
| 3B3v2 IgG-C234 scFv + CC | 401 | 523 | 371223 |
| 3B3 var IgG-3.2 var scFv | 403 | 523 | 381031 |
| 3B3 var IgG-3.2 var scFv | 405 | 523 | 381035 |
| 9C8 var IgG-3.2 var scFv | 407 | 447 | 381040 |
| 9C8 var IgG-3.2 var scFv | 409 | 447 | 381044 |
| 3B3 var IgG-3.2 var scFv + CC | 411 | 523 | 381048 |
| 3B3 var IgG-3.2 var scFv + CC | 413 | 523 | 381053 |
| 3B3 var IgG-C234 var scFv | 415 | 523 | 381058 |
| 3B3 var IgG-C234 var scFv | 417 | 523 | 381062 |
| 23B3 VH4 var IgG-adalimumab var scFv | 419 | 70 | 381066 |
| 23B3 VH4 var IgG-adalimumab var scFv | 421 | 70 | 381070 |
| 23B3 VH4 var IgG-adalimumab var scFv + CC | 423 | 70 | 381074 |
| 23B3 VH4 var IgG-adalimumab var scFv + CC | 425 | 70 | 381079 |

Each of the polypeptides in Table L is encoded by a nucleic acid having the nucleotide sequence immediately preceding the polypeptide sequence in the Sequence Listing.

TABLE M

Preferred TNF-α binding entity IgG- TL1A binding entity scFv antigen binding proteins

| Molecule designation | heavy chain SEQ ID NO | light chain SEQ ID NO | iPS |
|---|---|---|---|
| Adalimumab IgG-9C8 scFv | 82 | 46 | 369989 |
| Adalimumab IgG-23B3 VH4 scFv | 284 | 46 | 369990 |
| Adalimumab IgG-9C8 scFv + CC | 286 | 46 | 369992 |
| Adalimumab IgG-9C8 var scFv + CC | 441 | 453 | 381505 |

TABLE M-continued

Preferred TNF-α binding entity IgG- TL1A binding entity scFv antigen binding proteins

| Molecule designation | heavy chain SEQ ID NO | light chain SEQ ID NO | iPS |
|---|---|---|---|
| Adalimumab IgG-23B3 VH4 scFv + CC | 312 | 46 | 369993 |
| 3.2 IgG-9C8 scFv | 314 | 84 | 369995 |
| 3.2 IgG-23B3 VH4 scFv | 320 | 84 | 369996 |
| 3.2 IgG-9C8 scFv + CC | 322 | 84 | 369998 |
| 3.2 IgG-23B3 VH4 scFv + CC | 345 | 84 | 369999 |
| C234 IgG-9C8 scFv | 347 | 78 | 370001 |
| C234 IgG-23B3 VH4 scFv | 349 | 78 | 370002 |
| C234 IgG-9C8 scFv + CC | 351 | 78 | 370004 |
| C234 IgG 23B3 VH4 scFv + CC | 353 | 78 | 370005 |
| Adalimumab IgG-3B3v2 scFv | 379 | 46 | 371212 |
| Adalimumab IgG-3Bv2 scFv + CC | 381 | 46 | 371213 |
| 3.2 IgG-3B3v2 scFv | 383 | 84 | 371214 |
| 3.2 IgG-3B3v2 scFv + CC | 385 | 84 | 371215 |
| C234 IgG-3B3v2 scFv | 387 | 78 | 371216 |
| C234 IgG-3B3v2 scFv + CC | 389 | 78 | 371217 |
| 3.2 var IgG-9C8 var scFv | 427 | 449 | 381327 |
| 3.2 var IgG-9C8 var scFv | 429 | 449 | 381331 |
| C234 var IgG-9C8 var scFv | 431 | 451 | 381485 |
| C234 var IgG-9C8 var scFv + CC | 433 | 451 | 381489 |
| C234 var IgG-3B3 var scFv | 435 | 451 | 381493 |
| C234 var IgG-3B3 var scFv + CC | 437 | 451 | 381497 |
| Adalimumab var IgG-9C8 var scFv | 439 | 453 | 381501 |
| Adalimumab var IgG-9C8 var scFv + CC | 441 | 453 | 381505 |
| Adalimumab var IgG-3B3 var scFv | 443 | 453 | 381509 |
| Adalimumab var IgG-3B3 var scFv + CC | 445 | 453 | 381513 |

Each of the polypeptides in Table M is encoded by a nucleic acid having the nucleotide sequence immediately preceding the polypeptide sequence in the Sequence Listing.

IgG-Fab Bispecific Antigen Binding Proteins

In the IgG-Fab format, the bispecific, multivalent antigen binding protein comprises (i) a first polypeptide comprising a first heavy chain (VH2-CH1-CH2-CH3) from a first antibody, wherein the first heavy chain is fused at its carboxyl terminus (optionally through a peptide linker) to a polypeptide comprising VH2-CH1 domains of a second antibody to form a modified heavy chain, (ii) a second polypeptide comprising a light chain from a first antibody (VL1-CL) and (iii) a third polypeptide comprising VL2-CL domains of the second antibody. The CL and CH1 domains of the first antibody may be switched ("swapped") in some embodiments between the first and second polypeptide. In such embodiments, the second polypeptide comprises VL1-CH1, while the first polypeptide comprises VH1-CL-CH2-CH3-VH2-CH1 with VH1-CL-CH2-CH3 fused at its C-terminus to VH2-CH1 optionally through a peptide linker. The third polypeptide comprises VL2-CL. Alternatively, the CL and CH1 domains of the second antibody may be switched in some embodiments between the first and third polypeptides. In such embodiments, the third polypeptide comprises VL2-CH1, while the first polypeptide comprises VH1-CH1-CH2-CH3-VH2-CL wherein VH1-CH1-CH2-CH1 is fused at its C-terminus to VH2-CL optionally through a peptide linker. The second polypeptide comprises VL1-CL. In yet another embodiment, the CL and CH1 domains of both antibodies are switched between the first, second and third polypeptides. In such embodiments, the first polypeptide comprises VH1-CL-CH2-CH3-VH2-CL, with VH1-CL-CH2-CH3 optionally fused at its C-terminus to VH2-CL, the second polypeptide comprises VL1-CH1, and the third polypeptide comprises VL2-CH1. Within the scope of this invention are such IgG-Fab molecules in which the first antibody comprises a TL1A binding entity and the second antibody comprises a TNF-α binding entity. Likewise, also within the scope of this invention are such IgG-Fab molecules in which the first antibody comprises a TNF-α binding entity and the second antibody comprises a TL1A binding entity. An expression having the same meaning as the last two sentences is that the first antibody comprises one of a TL1A binding entity or a TNF-α binding entity and the second antibody comprises the other.

In one aspect of the IgG-Fab format within this invention, the bispecific, tetravalent antigen binding protein comprises a) a first heavy chain of a first antibody (VH1), wherein the first antibody specifically binds to a first antigen, and wherein the first heavy chain is fused through its C-terminus to the N-terminus of a moiety comprising a second heavy chain of a second antibody (VH2), wherein the second antibody specifically binds to a second antigen; b) two light chains of the first antibody of a); and c) two light chains of the second antibody of a). Within this invention, the first antibody may specifically bind TL1A and the second may specifically bind TNF-α or vice-versa.

In another aspect of the IgG-Fab format within this invention, the bispecific antigen binding protein comprises (i) a first binding domain that specifically binds to a first antigen comprising a first light chain immunoglobulin variable region (VL1) and a first heavy chain immunoglobulin variable region (VH1); (ii) a second binding domain that specifically binds to a second antigen comprising a second light chain immunoglobulin variable region (VL2) and a second heavy chain immunoglobulin variable region (VH2); and (iii) a human immunoglobulin Fc region, wherein one of the binding domains is positioned at the amino terminus of the Fc region and the other binding domain is positioned at the carboxyl terminus of the Fc region, wherein the carboxyl-terminal binding domain is a Fab and is fused through a peptide linker to the carboxyl terminus of the Fc region, and wherein the Fab is fused to the Fc region through the amino terminus of the VH region of the Fab. Within this invention, the first antigen may be TL1A and the second TNF-α or vice-versa.

In another aspect of the IgG-Fab format, the bispecific, tetravalent antigen binding protein comprises:

a) a first polypeptide comprising a first heavy chain of a first antibody comprising a first heavy chain variable region (VH1) and a first CH1 domain, wherein the first antibody specifically binds to a first antigen, and wherein the first heavy chain is fused through its C-terminus to the N-terminus of a polypeptide comprising a second heavy chain variable region of a second antibody (VH2), wherein the VH2 is fused through its C-terminus to the N-terminus of a second CH1 domain, and wherein the second antibody specifically binds to a second antigen; wherein
  i) the VH1 or first CH1 domain comprises at least one amino acid substitution to introduce a charged (e.g., positively charged) amino acid at a residue selected from the group consisting of positions 39, 44, and 183 using EU numbering; and
  ii) the VH2 or second CH1 domain comprises at least one amino acid substitution to introduce a charged (preferably oppositely charged from that of i) above) amino acid at a residue selected from the group consisting of a residue that corresponds to positions 39, 44, and 183 using EU numbering, wherein the charge is the opposite of the substituted residue of the VH1 or first CH1 of the first heavy chain; and b) a second polypeptide comprising a first light chain of the first antibody of a), wherein the first light chain comprises a first light chain variable region (VL1) and a first CL region; and wherein the VL1 or first CL domain comprises at least one amino acid substitution to introduce a charged amino acid at a residue selected from the group consisting of positions 38, 100, and 176 using EU numbering, wherein the charge at position 38 is the opposite of the substituted residue of the VH1 or first CH1 of the first heavy chain at position 39; the charge at position 100 is the opposite of the substituted residue of the VH1 or first CH1 of the first heavy chain at position 44; the charge at position 176 is the opposite of the substituted residue of the VH1 or first CH1 of the first heavy chain at position 183; and c) a third polypeptide comprising a second light chain of the second antibody of a), wherein the second light chain comprises a second light chain variable region (VL2) and a second CL region; and wherein the VL2 or second CL domain comprises at least one amino acid substitution to introduce a charged amino acid at a residue selected from the group consisting of positions 38, 100, and 176 using EU numbering, wherein the charge at position 38 is the opposite of the substituted residue of the VH2 or second CH1 of the second heavy chain at position 39; the charge at position 100 is the opposite of the substituted residue of the VH2 or second CH1 of the second heavy chain at position 44; the charge at position 176 is the opposite of the substituted residue of the VH2 or second CH1 of the second heavy chain at position 183.

Within this invention, the first antigen in subparagraph a) above may be one of TL1A and TNF-α and the second antigen may be the other. Another way of stating this same binding specificity is to say that the first antibody in subparagraph a) comprises one of a TL1A binding entity or a TNF-α binding entity and the second antibody comprises the other.

In some embodiments of the bispecific antigen binding proteins of the invention in which the carboxyl-terminal binding domain is a Fab fragment, the binding domain positioned at the amino terminus of the Fc region (i.e., the amino-terminal binding domain) is also a Fab fragment. The amino-terminal Fab fragment can be fused to the amino terminus of the Fc region through a peptide linker or an immunoglobulin hinge region described herein. In some embodiments, the amino-terminal Fab fragment is joined to the amino terminus of the Fc region through a human IgG1 hinge region. In other embodiments, the amino-terminal Fab fragment is joined to the amino terminus of the Fc region through a human IgG2 hinge region. In one embodiment, the amino-terminal Fab fragment is fused to the Fc region through the carboxyl terminus of the CH1 region of the Fab.

In some embodiments, the bispecific antigen binding protein of the invention comprises a first antibody that specifically binds to a first target where one polypeptide chain (e.g. the heavy chain (VH2-CH1)) of a Fab fragment from a second antibody that specifically binds to a second target is fused to the carboxyl terminus of the heavy chain of the first antibody. The bispecific antigen binding protein in such embodiments also comprises a polypeptide chain containing the other half of the Fab fragment from the second antibody (e.g., the light chain (VL2-CL)). This format is referred to herein as the "IgG-Fab" format, and one embodiment of this type of molecule is shown schematically in FIG. 25. Thus, in certain embodiments, the present invention includes a bispecific, multivalent antigen binding protein comprising: (i) a light chain from a first antibody, (ii) a heavy chain from the first antibody, wherein the heavy chain is fused at its carboxyl terminus through a peptide linker to a first polypeptide comprising VH-CH1 domains of a second antibody to form a modified heavy chain, and (iii)

a second polypeptide comprising VL-CL domains of the second antibody. When dimerized, the bispecific antigen binding protein is a homohexamer comprising two modified heavy chains, two light chains from the first antibody, and two polypeptide chains containing the other half of the Fab fragment from the second antibody (the Fd fragment). In one embodiment, the first polypeptide, which is fused to the carboxyl terminus of the heavy chain, comprises VH and CH1 domains from the second antibody, and the second polypeptide comprises VL and CL domains from the second antibody.

In certain embodiments, the antigen binding proteins of the invention comprise (i) a first binding domain that specifically binds a first target antigen, (ii) a second binding domain that specifically binds to a second target antigen, and (iii) a human immunoglobulin Fc region, wherein one of the binding domains is positioned at the amino terminus of the Fc region and the other binding domain is positioned at the carboxyl terminus of the Fc region. In some such embodiments, each of the first and second binding domains comprises immunoglobulin variable regions. For instance, in certain embodiments, the first binding domain comprises a first light chain variable region (VL1) and a first heavy chain variable region (VH1) from an anti-first target antigen antibody and the second binding domain comprises a second light chain variable region (VL2) and a second heavy chain variable region (VH2) from an anti-second target antigen antibody.

In certain embodiments of the bispecific antigen binding proteins of the invention, the binding domain positioned at the amino terminus of the Fc region (i.e. the amino-terminal binding domain) is a Fab fragment fused to the amino terminus of the Fc region through a peptide linker described herein or through an immunoglobulin hinge region. An "immunoglobulin hinge region" refers to the amino acid sequence connecting the CH1 domain and the CH2 domain of an immunoglobulin heavy chain. The hinge region of human IgG1 is generally defined as the amino acid sequence from about Glu216 or about Cys226, to about Pro230. Hinge regions of other IgG isotypes may be aligned with the IgG1 sequence by placing the first and last cysteine residues forming inter-heavy chain disulfide bonds in the same positions and are determinable to those of skill in the art. In some embodiments, the amino-terminal binding domain is joined to the amino terminus of the Fc region through a human IgG1 hinge region. In other embodiments, the amino-terminal binding domain is joined to the amino terminus of the Fc region through a human IgG2 hinge region. In one embodiment, the amino-terminal binding domain (e.g. Fab fragment) is fused to the Fc region through the carboxyl terminus of the CH1 region of the Fab.

In some embodiments of the antigen binding proteins of the invention, the binding domain positioned at the carboxyl terminus of the Fc region (i.e. the carboxyl-terminal binding domain) is a Fab fragment. In such embodiments, the Fab is fused or otherwise connected to the carboxyl terminus of the Fc region (e.g. the carboxyl terminus of the CH3 domain) through a peptide linker through the amino terminus of the VH region of the Fab fragment. Thus, in one embodiment, the Fab is fused to an Fc region through the amino terminus of the VH region of the Fab such that the resulting fusion protein comprises, from N-terminus to C-terminus, a CH2 domain, a CH3 domain, a peptide linker, a VH region, and a CH1 region.

In certain embodiments, the first heavy chain of an antigen binding protein of the present invention is fused to the VH2 via a peptide linker. In certain embodiments, the peptide linker comprises a sequence selected from the group consisting of $(Gly_3Ser)_2$, $(Gly_4Ser)_2$, $(Gly_3Ser)_3$, $(Gly_4Ser)_3$, $(Gly_3Ser)_4$, $(Gly_4Ser)_4$, $(Gly_3Ser)_5$, $(Gly_4Ser)_5$, $(Gly_3Ser)_6$, and $(Gly_4Ser)_6$ These sequences can also be written as:

GGGSGGGS, (SEQ ID NO: 673)

GGGGSGGGGS, (SEQ ID NO: 695)

GGGSGGGSGGGS, (SEQ ID NO: 703)

GGGGSGGGGSGGGGS, (SEQ ID NO: 729)

GGGSGGGSGGGSGGGS, (SEQ ID NO: 735)

GGGGSGGGGSGGGGSGGGGS, (SEQ ID NO: 825)

GGGSGGGSGGGSGGGSGGGS, (SEQ ID NO: 937)

GGGGSGGGGSGGGGSGGGGSGGGGS, (SEQ ID NO: 939)

GGGSGGGSGGGSGGGSGGGSGGGS, and (SEQ ID NO: 941)

GGGGSGGGGSGGGGSGGGGSGGGGSGGGGS. (SEQ ID NO: 945)

The peptide linker joining the Fc region to the carboxyl-terminal Fab can be any of the peptide linkers described herein. In particular embodiments, the peptide linker joining the Fc region to the carboxyl-terminal Fab fragment is at least 5 amino acids in length. In other embodiments, the peptide linker joining the Fc region to the carboxyl-terminal Fab fragment is at least 8 amino acids in length. Particularly suitable peptide linkers for joining the Fc region to the carboxyl-terminal Fab fragment are glycine-serine linkers, such as $(Gly_xSer)_m$ wherein x=3 or 4 and n=2, 3, 4, 5 or 6. In one embodiment, the peptide linker connecting the Fc region to the carboxyl-terminal Fab fragment is a L10 $(G_4S)_2$ linker. In another embodiment, the peptide linker connecting the Fc region to the carboxyl-terminal Fab fragment is a L9 or $G_3SG_4S$ linker (GGGSGGGGS, SEQ ID NO: 946).

Chain Mutations

In particular embodiments, the bispecific antigen binding proteins described herein comprise a Fc region from a human IgG1 antibody modified to remove effector functions. Such modified IgG1 Fc regions comprise substitutions R292C and V302C. In such embodiments, the Fc region may also comprise substitution N297G (known as a SEFL2 scaffold), Preferred embodiments further include mutations in the heavy and light chains to aid in correct assembly of a hetero IgG bispecific antigen binding protein. An approach for promoting heterodimer formation to the exclusion of homodimer formation entails utilizing an electrostatic steering mechanism (see Gunasekaran et al. (2010), *J. Biol. Chem.*, Vol. 285: 19637-19646, which is hereby incorporated by reference in its entirety). This approach involves introducing or exploiting charged residues in the CH3 domain in each heavy chain so that the two different heavy chains associate through opposite charges that cause electrostatic attraction. Homodimerization of the identical heavy chains are disfavored because the identical heavy chains have the same charge and therefore are repelled. This same electrostatic steering technique can be used to prevent mispairing of light chains with the non-cognate heavy chains by introducing residues having opposite charges in the correct light chain-heavy chain pair at the binding interface. The electrostatic steering technique and suitable charge pair mutations for promoting heterodimers and correct light chain-heavy chain pairing is described in WO2009/089004 and WO2014/081955, both of which are hereby incorporated by reference in their entireties.

In embodiments in which the bispecific antigen binding proteins of the invention are heterodimeric antibodies comprising a first light chain (LC1) and first heavy chain (HC1) from a first antibody that specifically binds to a first target antigen and a second light chain (LC2) and second heavy chain (HC2) from a second antibody that specifically binds to a second target, HC1 or HC2 may comprise one or more amino acid substitutions to replace a positively-charged amino acid with a negatively-charged amino acid. For instance, in one embodiment, the CH3 domain of HC1 or the CH3 domain of HC2 comprises an amino acid sequence differing from a wild-type IgG amino acid sequence such that one or more positively-charged amino acids (e.g., lysine, histidine and arginine) in the wild-type human IgG amino acid sequence are replaced with one or more negatively-charged amino acids (e.g., aspartic acid and glutamic acid) at the corresponding position(s) in the CH3 domain. In these and other embodiments, amino acids (e.g. lysine) at one or more positions selected from 370, 392 and 409 (EU numbering system) are replaced with a negatively-charged amino acid (e.g., aspartic acid and glutamic acid). An amino acid substitution in an amino acid sequence is typically designated herein with a one-letter abbreviation for the amino acid residue in a particular position, followed by the numerical amino acid position relative to an original sequence of interest, which is then followed by the one-letter symbol for the amino acid residue substituted in. For example, "T30D" symbolizes a substitution of a threonine residue by an aspartate residue at amino acid position 30, relative to the original sequence of interest. Another example, "S218G" symbolizes a substitution of a serine residue by a glycine residue at amino acid position 218, relative to the original amino acid sequence of interest.

In certain embodiments, HC1 or HC2 of the heterodimeric antibodies may comprise one or more amino acid substitutions to replace a negatively-charged amino acid with a positively-charged amino acid. For instance, in one embodiment, the CH3 domain of HC1 or the CH3 domain of HC2 comprises an amino acid sequence differing from wild-type IgG amino acid sequence such that one or more negatively-charged amino acids in the wild-type human IgG amino acid sequence are replaced with one or more positively-charged amino acids at the corresponding position(s) in the CH3 domain. In these and other embodiments, amino acids (e.g., aspartic acid or glutamic acid) at one or more positions selected from 356, 357, and 399 (EU numbering system) of the CH3 domain are replaced with a positively-charged amino acid (e.g., lysine, histidine and arginine).

In particular embodiments, the heterodimeric antibody comprises a first heavy chain comprising negatively-charged amino acids at positions 392 and 409 (e.g., K392D and K409D substitutions), and a second heavy chain comprising positively-charged amino acids at positions 356 and 399 (e.g., E356K and D399K substitutions). In other particular embodiments, the heterodimeric antibody comprises a first heavy chain comprising negatively-charged amino acids at positions 392, 409, and 370 (e.g., K392D, K409D, and K370D substitutions), and a second heavy chain comprising positively-charged amino acids at positions 356, 399, and 357 (e.g., E356K, D399K, and E357K substitutions). In related embodiments, the first heavy chain is from an anti-first target antigen antibody and the second heavy chain is from an anti-second target antigen antibody.

To facilitate the association of a particular heavy chain with its cognate light chain, both the heavy and light chains may contain complementary amino acid substitutions. As used herein, "complementary amino acid substitutions" refer to a substitution to a positively-charged amino acid in one chain paired with a negatively-charged amino acid substitution in the other chain. For example, in some embodiments, the heavy chain comprises at least one amino acid substitution to introduce a charged amino acid and the corresponding light chain comprises at least one amino acid substitution to introduce a charged amino acid, wherein the charged amino acid introduced into the heavy chain has the opposite charge of the amino acid introduced into the light chain. In certain embodiments, one or more positively-charged residues (e.g., lysine, histidine or arginine) can be introduced into a first light chain (LC1) and one or more negatively-charged residues (e.g., aspartic acid or glutamic acid) can be introduced into the companion heavy chain (HC1) at the binding interface of LC1/HC1, whereas one or more negatively-charged residues (e.g., aspartic acid or glutamic acid) can be introduced into a second light chain (LC2) and one or more positively-charged residues (e.g., lysine, histidine or arginine) can be introduced into the companion heavy chain (HC2) at the binding interface of LC2/HC2. The electrostatic interactions will direct the LC1 to pair with HC1 and LC2 to pair with HC2, as the opposite charged residues (polarity) at the interface attract. The heavy/light chain pairs having the same charged residues (polarity) at an interface (e.g. LC1/HC2 and LC2/HC1) will repel, resulting in suppression of the unwanted HC/LC pairings.

In these and other embodiments, the CH1 domain of the heavy chain or the CL domain of the light chain comprises an amino acid sequence differing from a wild-type IgG amino acid sequence such that one or more positively-charged amino acids in a wild-type IgG amino acid sequence is replaced with one or more negatively-charged amino acids. Alternatively, the CH1 domain of the heavy chain or the CL domain of the light chain comprises an amino acid sequence differing from a wild-type IgG amino acid sequence such that one or more negatively-charged amino acids in a wild-type IgG amino acid sequence is replaced with one or more positively-charged amino acids. In some embodiments, one or more amino acids in the CH1 domain of the first and/or second heavy chain in the heterodimeric antibody at an EU position selected from F126, P127, L128, A141, L145, K147, D148, H168, F170, P171, V173, Q175, S176, S183, V185 and K213 is replaced with a charged amino acid. In certain embodiments, a heavy chain residue for substitution with a negatively- or positively-charged amino acid is S183 (EU numbering system). In some embodiments, S183 is substituted with a positively-charged amino acid. In alternative embodiments, S183 is substituted with a negatively-charged amino acid. For instance, in one embodiment, 5183 is substituted with a negatively-charged amino acid (e.g. S183E) in the first heavy chain, and 5183 is substituted with a positively-charged amino acid (e.g. S183K) in the second heavy chain.

In embodiments in which the light chain is a kappa light chain, one or more amino acids in the CL domain of the first and/or second light chain in the heterodimeric antibody at a position (EU numbering in a kappa light chain) selected from F116, F118, S121, D122, E123, Q124, 5131, V133, L135, N137, N138, Q160, 5162, T164, 5174 and 5176 is replaced with a charged amino acid. In embodiments in which the light chain is a lambda light chain, one or more amino acids in the CL domain of the first and/or second light chain in the heterodimeric antibody at a position (EU numbering in a lambda chain) selected from T116, F118, 5121, E123, E124, K129, T131, V133, L135, 5137, E160, T162, 5165, Q167, A174, 5176 and Y178 is replaced with a charged amino acid. In some embodiments, a residue for substitution with a negatively- or positively-charged amino acid is S176 (EU numbering system) of the CL domain of either a kappa or lambda light chain. In certain embodiments, S176 of the CL domain is replaced with a positively-charged amino acid. In alternative embodiments, S176 of the CL domain is replaced with a negatively-charged amino acid. In one embodiment, S176 is substituted with a positively-charged amino acid (e.g. S176K) in the first light chain, and S176 is substituted with a negatively-charged amino acid (e.g. S176E) in the second light chain.

In addition to or as an alternative to the complementary amino acid substitutions in the CH1 and CL domains, the variable regions of the light and heavy chains in the heterodimeric antibody may contain one or more complementary amino acid substitutions to introduce charged amino acids. For instance, in some embodiments, the VH region of the heavy chain or the VL region of the light chain of a heterodimeric antibody comprises an amino acid sequence differing from wild-type IgG amino acid sequence such that one or more positively-charged amino acids in wild-type IgG amino acid sequence is replaced with one or more negatively-charged amino acids. Alternatively, the VH region of the heavy chain or the VL region of the light chain comprises an amino acid sequence differing from a wild-type IgG amino acid sequence such that one or more negatively-charged amino acids in a wild-type IgG amino acid sequence is replaced with one or more positively-charged amino acids.

V region interface residues (i.e., amino acid residues that mediate assembly of the VH and VL regions) within the VH region include EU positions 1, 3, 35, 37, 39, 43, 44, 45, 46, 47, 50, 59, 89, 91, and 93. One or more of these interface residues in the VH region can be substituted with a charged (positively- or negatively-charged) amino acid. In certain embodiments, the amino acid at EU position 39 in the VH region of the first and/or second heavy chain is substituted for a positively-charged amino acid, e.g., lysine. In alternative embodiments, the amino acid at EU position 39 in the VH region of the first and/or second heavy chain is substituted for a negatively-charged amino acid, e.g., glutamic acid. In some embodiments, the amino acid at EU position 39 in the VH region of the first heavy chain is substituted for a negatively-charged amino acid (e.g., G39E), and the amino acid at EU position 39 in the VH region of the second heavy chain is substituted for a positively-charged amino acid (e.g., G39K). In some embodiments, the amino acid at EU position 44 in the VH region of the first and/or second heavy chain is substituted for a positively-charged amino acid; for example, lysine. In alternative embodiments, the amino acid at EU position 44 in the VH region of the first and/or second heavy chain is substituted for a negatively-charged amino acid; for example, glutamic acid. In certain embodiments, the amino acid at EU position 44 in the VH region of the first heavy chain is substituted for a negatively-charged amino acid (e.g., G44E), and the amino acid at EU position 44 in the VH region of the second heavy chain is substituted for a positively-charged amino acid (e.g., G44K).

V region interface residues (i.e., amino acid residues that mediate assembly of the VH and VL regions) within the VL region include EU positions 32, 34, 35, 36, 38, 41, 42, 43, 44, 45, 46, 48, 49, 50, 51, 53, 54, 55, 56, 57, 58, 85, 87, 89, 90, 91, and 100. One or more interface residues in the VL region can be substituted with a charged amino acid, preferably an amino acid that has an opposite charge to those introduced into the VH region of the cognate heavy chain. In some embodiments, the amino acid at EU position 100 in the VL region of the first and/or second light chain is substituted for a positively-charged amino acid; for example, lysine. In alternative embodiments, the amino acid at EU position 100 in the VL region of the first and/or second light chain is substituted for a negative-charged amino acid; for example, s glutamic acid. In certain embodiments, the amino acid at EU position 100 in the VL region of the first light chain is substituted for a positively-charged amino acid (e.g. G100K), and the amino acid at EU position 100 in the VL region of the second light chain is substituted for a negatively-charged amino acid (e.g. G100E).

In certain embodiments, a heterodimeric antibody of the invention comprises a first heavy chain and a second heavy chain and a first light chain and a second light chain, wherein the first heavy chain comprises amino acid substitutions at positions 44 (EU), 183 (EU), 392 (EU) and 409 (EU), wherein the second heavy chain comprises amino acid substitutions at positions 44 (EU), 183 (EU), 356 (EU) and 399 (EU), wherein the first and second light chains comprise an amino acid substitution at positions 100 (EU) and 176 (EU), and wherein the amino acid substitutions introduce a charged amino acid at the positions. In related embodiments, the glycine at position 44 (EU) of the first heavy chain is replaced with glutamic acid, the glycine at position 44 (EU) of the second heavy chain is replaced with lysine, the glycine at position 100 (EU) of the first light chain is replaced with lysine, the glycine at position 100 (EU) of the second light chain is replaced with glutamic acid, the serine at position 176 (EU) of the first light chain is replaced with lysine, the serine at position 176 (EU) of the second light chain is replaced with glutamic acid, the serine at position 183 (EU) of the first heavy chain is replaced with glutamic acid, the lysine at position 392 (EU) of the first heavy chain is replaced with aspartic acid, the lysine at position 409 (EU) of the first heavy chain is replaced with aspartic acid, the serine at position 183 (EU) of the second heavy chain is replaced with lysine, the glutamic acid at position 356 (EU) of the second heavy chain is replaced with lysine, and/or the aspartic acid at position 399 (EU) of the second heavy chain is replaced with lysine.

In other embodiments, a heterodimeric antibody of the invention comprises a first heavy chain and a second heavy chain and a first light chain and a second light chain, wherein the first heavy chain comprises amino acid substitutions at positions 183 (EU), 392 (EU) and 409 (EU), wherein the second heavy chain comprises amino acid substitutions at positions 183 (EU), 356 (EU) and 399 (EU), wherein the first and second light chains comprise an amino acid substitution at position 176 (EU), and wherein the amino acid substitutions introduce a charged amino acid at the positions. In related embodiments, the serine at position 176 (EU) of the first light chain is replaced with lysine, the serine at position 176 (EU) of the second light chain is replaced with glutamic acid, the serine at position 183 (EU) of the first heavy chain is replaced with glutamic acid, the lysine at position 392 (EU) of the first heavy chain is replaced with aspartic acid, the lysine at position 409 (EU) of the first heavy chain is replaced with aspartic acid, the serine at position 183 (EU) of the second heavy chain is replaced with lysine, the glutamic acid at position 356 (EU) of the second heavy chain is replaced with lysine, and/or the aspartic acid at position 399 (EU) of the second heavy chain is replaced with lysine.

In still other embodiments, a heterodimeric antibody of the invention comprises a first heavy chain and a second heavy chain and a first light chain and a second light chain, wherein the first heavy chain comprises amino acid substitutions at positions 183 (EU), 392 (EU), 409 (EU), and 370 (EU), wherein the second heavy chain comprises amino acid substitutions at positions 183 (EU), 356 (EU), 399 (EU), and 357 (EU), wherein the first and second light chains comprise an amino acid substitution at position 176 (EU), and wherein the amino acid substitutions introduce a charged amino acid at the positions. In related embodiments, the serine at position 176 (EU) of the first light chain is replaced with lysine, the serine at position 176 (EU) of the second light chain is replaced with glutamic acid, the serine at position 183 (EU) of the first heavy chain is replaced with glutamic acid, the lysine at position 392 (EU) of the first heavy chain is replaced with aspartic acid, the lysine at position 409 (EU) of the first heavy chain is replaced with aspartic acid, the lysine at position 370 (EU) of the first heavy chain is replaced with aspartic acid, the serine at position 183 (EU) of the second heavy chain is replaced with lysine, the glutamic acid at position 356 (EU) of the second heavy chain is replaced with lysine, the aspartic acid at position 399 (EU) of the second heavy chain is replaced with lysine, and/or the glutamic acid at position 357 (EU) of the second heavy chain is replaced with lysine.

Any of the constant domains can be modified to contain one or more of the charge pair mutations described above to facilitate correct assembly of a heterodimeric antibody.

The inventive heterodimeric antibodies also encompass antibodies comprising the heavy chain(s) and/or light chain(s), where one, two, three, four or five amino acid residues are lacking from the N-terminus or C-terminus, or both, in relation to any one of the heavy and light chains, e.g., due to post-translational modifications resulting from the type of host cell in which the antibodies are expressed. For instance, Chinese Hamster Ovary (CHO) cells frequently cleave off a C-terminal lysine from antibody heavy chains.

Charge pair mutations or complementary amino acid substitutions as described herein can be introduced into the Fab regions of the first antibody (Fab 1) or second antibody (Fab 2) to promote correct heavy chain-light chain pairing. For instance, in some embodiments, the amino acid at EU position 38 of the VL domain in Fab 1 is replaced with a negatively-charged amino acid (e.g. glutamic acid) and the amino acid at EU position 39 of the VH domain in Fab 1 is replaced with a positively-charged amino acid (e.g. lysine). In other embodiments, the amino acid at EU position 38 of the VL domain in Fab 1 is replaced with a positively-charged amino acid (e.g. lysine) and the amino acid at EU position 39 of the VH domain in Fab 1 is replaced with a negatively-charged amino acid (e.g. glutamic acid). In certain embodiments, the amino acid at EU position 38 of the VL domain in Fab 2 is replaced with a negatively-charged amino acid (e.g. glutamic acid) and the amino acid at EU position 39 of the VH domain in Fab 2 is replaced with a positively-charged amino acid (e.g. lysine). In other embodiments, the amino acid at EU position 38 of the VL domain in Fab 2 is replaced with a positively-charged amino acid (e.g. lysine) and the amino acid at EU position 39 of the VH domain in Fab 2 is replaced with a negatively-charged amino acid (e.g. glutamic acid).

In embodiments in which the VH-CH1 region (i.e. Fd fragment) from the second antibody is fused to the heavy chain of the first antibody, the heavy chain from the first antibody comprises a S183E mutation (EU numbering), the light chain from the first antibody comprises a S176K mutation (EU numbering), the light chain from the second antibody comprises a S176E mutation (EU numbering), and the Fd region from the second antibody (which is fused to the C-terminus of the heavy chain from the first antibody) comprises a S183K mutation (EU numbering). In other embodiments, the heavy chain from the first antibody comprises a G44E mutation (EU) and S183E mutation (EU numbering), the light chain from the first antibody comprises a G100K mutation (EU) and S176K mutation (EU numbering), the light chain from the second antibody comprises a G100E mutation (EU) and S176E mutation (EU numbering), and the Fd region from the second antibody (which is fused to the C-terminus of the heavy chain from the first antibody) comprises a G44K mutation (EU) and S183K mutation (EU numbering). The charges in the foregoing examples may be reversed so long as the charge on the corresponding light or heavy chain is also reversed so that the correct heavy/light chain pairs have opposite charges.

In one embodiment, the present invention is directed to a bispecific, tetravalent antigen binding protein, comprising:

a) a first polypeptide comprising a first heavy chain of a first antibody comprising a first heavy chain variable region (VH1) and a first CH1 domain, wherein the first antibody specifically binds to a first antigen, and wherein the first heavy chain is fused through its C-terminus to the N-terminus of a polypeptide comprising a second heavy chain variable region of a second antibody (VH2), wherein the VH2 is fused through its C-terminus to the N-terminus of a second CH1 domain, and wherein the second antibody specifically binds to a second antigen; wherein i) the VH1 or first CH1 domain comprises at least one amino acid substitution to introduce a charged (e.g., positively charged) amino acid at a residue selected from the group consisting of positions 39, 44, and 183 using EU numbering; and ii) the VH2 or second CH1 domain comprises at least one amino acid substitution to introduce an oppositely charged (e.g., negatively charged) amino acid at a residue selected from the group consisting of a residue that corresponds to positions 39, 44, and 183 using EU numbering; and b) a second polypeptide comprising a first light chain of the first antibody of a), wherein the first light chain comprises a first light chain variable region (VL1) and a first CL region; and wherein the VL1 or first CL domain comprises at least one amino acid substitution to introduce a negatively charged amino acid at a residue selected from the group consisting of positions 38, 100, and 176 using EU numbering; and c) a third polypeptide comprising a second light chain of the second antibody of a), wherein the second light chain comprises a second light chain variable region (VL2) and a second CL region; and wherein the VL1 or first CL domain comprises at least one amino acid substitution to introduce a positively charged amino acid at a residue selected from the group consisting of positions 38, 100, and 176 using EU numbering.

Within this invention, the first antigen in subparagraph a) above may be one of TL1A and TNF-α and the second antigen may be the other. Another way of stating this same binding specificity is to say that the first antibody in subparagraph a) comprises one of a TL1A binding entity or a TNF-α binding entity and the second antibody comprises the other.

"Corresponds to" as it pertains to the VH2 and second CH1 domain means that the amino acid residues of the VH2 and second CH1 domain are counted from the C-terminus of the first heavy chain if there is no linker. If there is a peptide linker, the amino acid residues of the VH2 and second CH1 domain are counted from the C-terminus of the peptide linker. In neither case are the amino acid residues counted from the N-terminus of the first heavy chain. Rather, for the VH2 and second CH1 domain, counting begins at the first amino acid residue of the VH2 domain. The counting of amino acid residues is performed using the EU or AHo convention.

In certain embodiments: a) the VH1 or first CH1 domain comprises a mutation selected from the group consisting of Q39K, G44K, and S183K using EU numbering; b) the VH2 or second CH1 domain comprises a mutation selected from the group consisting of Q39E, G44E, and S183E using EU numbering; c) the VL1 or first CL domain comprises a mutation selected from the group consisting of Q38E, G100E, and S176E using EU numbering; and d) the VL2 or second CL domain comprises a mutation selected from the group consisting of Q38K, G100K, and S176K using EU numbering.

In certain embodiments: a) the VH1 comprises a Q39K mutation and the first CH1 domain comprises a S183K mutation using EU numbering; b) the VH2 comprises a Q39E mutation and the second CH1 domain comprises a S183E mutation using EU numbering; c) the VL1 comprises a Q38E mutation and the first CL domain comprises a S176E mutation using EU numbering; and d) the VL2 comprises a Q38K mutation and the second CL domain comprises a S176K mutation using EU numbering.

In certain embodiments: a) the first CH1 domain comprises G44K and S183K mutations using EU numbering; b) the second CH1 domain comprises G44E and S183E mutations using EU numbering; c) the first CL domain comprises G100E and S176E mutations using EU numbering; and d) the second CL domain comprises G100K and S176K mutations using EU numbering.

In one embodiment the present invention is directed to a bispecific, tetravalent antigen binding protein, comprising:
  a) a first polypeptide comprising a first heavy chain of a first antibody comprising a first heavy chain variable region (VH1) and a first CH1 domain, wherein the first antibody specifically binds to a first antigen, and wherein the first heavy chain is fused through its C-terminus to the N-terminus of a polypeptide comprising a second heavy chain variable region of a second antibody (VH2), wherein the VH2 is fused through its C-terminus to the N-terminus of a second CH1 domain, and wherein the second antibody specifically binds to a second antigen; wherein
    i) the VH1 or first CH1 domain comprises at least one amino acid substitution to introduce a negatively charged amino acid at a residue selected from the group consisting of positions 39, 44, and 183 using EU numbering; and
    ii) the VH2 or second CH1 domain comprises at least one amino acid substitution to introduce a positively charged amino acid at a residue selected from the group consisting of a residue that corresponds to positions 39, 44, and 183 using EU numbering; and b) a second polypeptide comprising a first light chain of the first antibody of a), wherein the first light chain comprises a first light chain variable region (VL1) and a first CL region; and wherein the VL1 or first CL domain comprises at least one amino acid substitution to introduce a positively charged amino acid at a residue selected from the group consisting of positions 38, 100, and 176 using EU numbering; and
  c) a third polypeptide comprising a second light chain of the second antibody of a), wherein the second light chain comprises a second light chain variable region (VL2) and a second CL region; and wherein the VL1 or first CL domain comprises at least one amino acid substitution to introduce a negatively charged amino acid at a residue selected from the group consisting of positions 38, 100, and 176 using EU numbering.

Within this invention, the first antigen in subparagraph a) above may be one of TL1A and TNF-α and the second antigen may be the other. Another way of stating this same binding specificity is to say that the first antibody in subparagraph a) comprises one of a TL1A binding entity or a TNF-α binding entity and the second antibody comprises the other.

In certain embodiments: a) the VH1 or first CH1 domain comprises a mutation selected from the group consisting of Q39E, G44E, and S183E using EU numbering; b) the VH2 or second CH1 domain comprises a mutation selected from the group consisting of Q39K, G44K, and S183K using EU numbering; c) the VL1 or first CL domain comprises a mutation selected from the group consisting of Q38K, G100K, and S176K using EU numbering; and d) the VL2 or second CL domain comprises a mutation selected from the group consisting of Q38E, G100E, and S176E using EU numbering.

In certain embodiments: a) the first CH1 domain comprises a S183E mutation using EU numbering; b) the second CH1 domain comprises a S183K mutation using EU numbering; c) the first CL domain comprises a S176K mutation using EU numbering; and d) the second CL domain comprises a S176E mutation using EU numbering.

In certain embodiments: a) the VH1 comprises a Q39E mutation and the first CH1 domain comprises a S183E mutation using EU numbering; b) the VH2 comprises a Q39K mutation and the second CH1 domain comprises a S183K mutation using EU numbering; c) the VL1 comprises a Q38K mutation and the first CL domain comprises a S176K mutation using EU numbering; and d) the VL2 comprises a Q38E mutation and the second CL domain comprises a S176E mutation using EU numbering.

In certain embodiments: a) the first CH1 domain comprises G44E and S183E mutations using EU numbering; b) the second CH1 domain comprises G44K and S183K mutations using EU numbering; c) the first CL domain comprises G100K and S176K mutations using EU numbering; and d) the second CL domain comprises G100E and S176E mutations using EU numbering.

In one embodiment the present invention is directed to a bispecific, tetravalent antigen binding protein, comprising:
  a) a first polypeptide comprising a first heavy chain of a first antibody comprising a first heavy chain variable region (VH1) and a first CH1 domain, wherein the first antibody specifically binds to a first antigen, and wherein the first heavy chain is fused through its C-terminus to the N-terminus of a polypeptide comprising a second heavy chain variable region of a second antibody (VH2), wherein the VH2 is fused through its C-terminus to the N-terminus of a second CH1 domain, and wherein the second antibody specifically binds to a second antigen; wherein
  i) the VH1 or first CH1 domain comprises at least one amino acid substitution to introduce a charged amino acid at a residue selected from the group consisting of positions 39, 44, and 183 using EU numbering; and
  ii) the VH2 or second CH1 domain comprises at least one amino acid substitution to introduce a charged amino acid at a residue selected from the group consisting of a residue that corresponds to positions 39, 44, and 183 using EU numbering, wherein the charge is the opposite of the substituted residue of the VH1 or first CH1 of the first heavy chain; and
b) a second polypeptide comprising a first light chain of the first antibody of a), wherein the first light chain comprises a first light chain variable region (VL1) and a first CL region; and wherein the VL1 or first CL domain comprises at least one amino acid substitution to introduce a charged amino acid at a residue selected from the group consisting of positions 38, 100, and 176 using EU numbering, wherein
  the charge at position 38 is the opposite of the substituted residue of the VH1 or first CH1 of the first heavy chain at position 39; the charge at position 100 is the opposite of the substituted residue of the VH1 or first CH1 of the first heavy chain at position 44; the charge at position 176 is the opposite of the substituted residue of the VH1 or first CH1 of the first heavy chain at position 183; and
c) a third polypeptide comprising a second light chain of the second antibody of a), wherein the second light chain comprises a second light chain variable region (VL2) and a second CL region; and wherein the VL2 or second CL domain comprises at least one amino acid substitution to introduce a charged amino acid at a residue selected from the group consisting of positions 38, 100, and 176 using EU numbering, wherein
  the charge at position 38 is the opposite of the substituted residue of the VH2 or second CH1 of the second heavy chain at position 39; the charge at position 100 is the opposite of the substituted residue of the VH2 or second CH1 of the second heavy chain at position 44; the charge at position 176 is the opposite of the substituted residue of the VH2 or second CH1 of the second heavy chain at position 183.

Within this invention, the first antigen in subparagraph a) above may be one of TL1A and TNF-α and the second antigen may be the other. Another way of stating this same binding specificity is to say that the first antibody in subparagraph a) comprises one of a TL1A binding entity or a TNF-α binding entity and the second antibody comprises the other.

In certain embodiments: a) the VH1 comprises a Q39E mutation and the first CH1 domain comprises a S183K mutation using EU numbering; b) the VH2 comprises a Q39K mutation and the second CH1 domain comprises a S183E mutation using EU numbering; c) the VL1 comprises a Q38K mutation and the first CL domain comprises a S176E mutation using EU numbering; and d) the VL2 comprises a Q38E mutation and the second CL domain comprises a S176K mutation using EU numbering.

In certain embodiments: a) the first CH1 domain comprises G44E and S183K mutations using EU numbering; b) the second CH1 domain comprises G44K and S183E mutations using EU numbering; c) the first CL domain comprises G100K and S176E mutations using EU numbering; and d) the second CL domain comprises G100E and S176K mutations using EU numbering.

In certain embodiments: a) the VH1 comprises a Q39K mutation and the first CH1 domain comprises a S183E mutation using EU numbering; b) the VH2 comprises a Q39E mutation and the second CH1 domain comprises a S183K mutation using EU numbering; c) the VL1 comprises a Q38E mutation and the first CL domain comprises a S176K mutation using EU numbering; and d) the VL2 comprises a Q38K mutation and the second CL domain comprises a S176E mutation using EU numbering.

In certain embodiments: a) the first CH1 domain comprises G44K and S183E mutations using EU numbering; b) the second CH1 domain comprises G44E and S183K mutations using EU numbering; c) the first CL domain comprises G100E and S176K mutations using EU numbering; and d) the second CL domain comprises G100K and S176E mutations using EU numbering.

In one embodiment the present invention is directed to a method for preparing a bispecific, tetravalent antigen binding protein, comprising:
  1) co-expressing in a host cell;
    a) a first polynucleotide wherein the first polynucleotide encodes a first polypeptide comprising a first heavy chain of a first antibody comprising a first heavy chain variable region (VH1) and a first CH1 domain, wherein the first antibody specifically binds to a first antigen, and wherein the first heavy chain is fused through its C-terminus to the N-terminus of a polypeptide comprising a second heavy chain variable region of a second antibody (VH2), wherein the VH2 is fused through its C-terminus to the N-terminus of a second CH1 domain, and wherein the second antibody specifically binds to a second antigen; wherein
      i) the VH1 or first CH1 domain comprises at least one amino acid substitution to introduce a positively charged amino acid at a residue selected from the group consisting of positions 39, 44, and 183 using EU numbering; and
      ii) the VH2 or second CH1 domain comprises at least one amino acid substitution to introduce a negatively charged amino acid at a residue selected from the group consisting of a residue that corresponds to positions 39, 44, and 183 using EU numbering; and
    b) a second polynucleotide wherein the second polynucleotide encodes a second polypeptide comprising a light chain of the first antibody of a), wherein the light chain comprises a first light chain variable region (VL1) and a first CL region; and wherein the VL1 or first CL domain comprises at least one amino acid substitution to introduce a negatively charged amino acid at a residue selected from the group consisting of positions 38, 100, and 176 using EU numbering;
    c) a third polynucleotide wherein the third polynucleotide encodes a third polypeptide comprising a light chain of the second antibody of a), wherein the light chain comprises a second light chain variable region (VL2) and a second CL region; and wherein the VL1 or first CL domain comprises at least one amino acid substitution to introduce a positively charged amino acid at a residue selected from the group consisting of positions 38, 100, and 176 using EU numbering;
  2) cultivating the host cell under conditions such that the polypeptides are produced; and
  3) recovering from the host cell the antigen binding protein.

Within this invention, the first antigen in subparagraph a) above may be one of TL1A and TNF-α and the second antigen may be the other. Another way of stating this same binding specificity is to say that the first antibody in subparagraph a) comprises one of a TL1A binding entity or a TNF-α binding entity and the second antibody comprises the other.

In one embodiment the present invention is directed to a method for preparing a bispecific, tetravalent antigen binding protein, comprising:
1) co-expressing in a host cell:
  a) a first polynucleotide wherein the first polynucleotide encodes a first polypeptide comprising a first heavy chain of a first antibody comprising a first heavy chain variable region (VH1) and a first CH1 domain, wherein the first antibody specifically binds to a first antigen, and wherein the first heavy chain is fused through its C-terminus to the N-terminus of a polypeptide comprising a second heavy chain variable region of a second antibody (VH2), wherein the VH2 is fused through its C-terminus to the N-terminus of a second CH1 domain, and wherein the second antibody specifically binds to a second antigen; wherein
    i) the VH1 or first CH1 domain comprises at least one amino acid substitution to introduce a negatively charged amino acid at a residue selected from the group consisting of positions 39, 44, and 183 using EU numbering; and
    ii) the VH2 or second CH1 domain comprises at least one amino acid substitution to introduce a positively charged amino acid at a residue selected from the group consisting of a residue that corresponds to positions 39, 44, and 183 using EU numbering; and
  b) a second polynucleotide wherein the second polynucleotide encodes a second polypeptide comprising a first light chain of the first antibody of a), wherein the first light chain comprises a first light chain variable region (VL1) and a first CL region; and wherein the VL1 or first CL domain comprises at least one amino acid substitution to introduce a positively charged amino acid at a residue selected from the group consisting of positions 38, 100, and 176 using EU numbering; and
  c) a third polynucleotide wherein the third polynucleotide encodes a third polypeptide comprising a second light chain of the second antibody of a), wherein the second light chain comprises a second light chain variable region (VL2) and a second CL region; and wherein the VL1 or first CL domain comprises at least one amino acid substitution to introduce a negatively charged amino acid at a residue selected from the group consisting of positions 38, 100, and 176 using EU numbering;
2) cultivating the host cell under conditions such that the polypeptides are produced; and
3) recovering from the host cell the antigen binding protein.

Within this invention, the first antigen in subparagraph a) above may be one of TL1A and TNF-α and the second antigen may be the other. Another way of stating this same binding specificity is to say that the first antibody in subparagraph a) comprises one of a TL1A binding entity or a TNF-α binding entity and the second antibody comprises the other.

In one embodiment the present invention is directed to a method for preparing a bispecific, tetravalent antigen binding protein, comprising:
1) co-expressing in a host cell:
  a) a first polynucleotide wherein the first polynucleotide encodes a first polypeptide comprising a first heavy chain of a first antibody comprising a first heavy chain variable region (VH1) and a first CH1 domain, wherein the first antibody specifically binds to a first antigen, and wherein the first heavy chain is fused through its C-terminus to the N-terminus of a polypeptide comprising a second heavy chain variable region of a second antibody (VH2), wherein the VH2 is fused through its C-terminus to the N-terminus of a second CH1 domain, and wherein the second antibody specifically binds to a second antigen; wherein
    i) the VH1 or first CH1 domain comprises at least one amino acid substitution to introduce a charged amino acid at a residue selected from the group consisting of positions 39, 44, and 183 using EU numbering; and
    ii) the VH2 or second CH1 domain comprises at least one amino acid substitution to introduce a charged amino acid at a residue selected from the group consisting of a residue that corresponds to positions 39, 44, and 183 using EU numbering, wherein the charge is the opposite of the substituted residue of the VH1 or first CH1 of the first heavy chain; and
  b) a second polynucleotide wherein the second polynucleotide encodes a second polypeptide comprising a light chain of the first antibody of a), wherein the light chain comprises a first light chain variable region (VL1) and a first CL region; and wherein the VL1 or first CL domain comprises at least one amino acid substitution to introduce a charged amino acid at a residue selected from the group consisting of positions 38, 100, and 176 using EU numbering, wherein
    the charge at position 38 is the opposite of the substituted residue of the VH1 or first CH1 of the first heavy chain at position 39; the charge at position 100 is the opposite of the substituted residue of the VH1 or first CH1 of the first heavy chain at position 44; the charge at position 176 is the opposite of the substituted residue of the VH1 or first CH1 of the first heavy chain at position 183; and
  c) a third polynucleotide wherein the third polynucleotide encodes a third polypeptide comprising a light chain of the second antibody of a), wherein the light chain comprises a second light chain variable region (VL2) and a second CL region; and wherein the VL1 or first CL domain comprises at least one amino acid substitution to introduce a positively charged amino acid at a residue selected from the group consisting of positions 38, 100, and 176 using EU numbering, wherein
    the charge at position 38 is the opposite of the substituted residue of the VH2 or second CH1 of the second heavy chain at position 39; the charge at position 100 is the opposite of the substituted residue of the VH2 or second CH1 of the second heavy chain at position 44; the charge at position 176 is the opposite of the substituted residue of the VH2 or second CH1 of the second heavy chain at position 183;
2) cultivating the host cell under conditions such that the polypeptides are produced; and
3) recovering from the host cell the antigen binding protein.

Within this invention, the first antigen in subparagraph a) above may be one of TL1A and TNF-α and the second antigen may be the other. Another way of stating this same binding specificity is to say that the first antibody in subparagraph a) comprises one of a TL1A binding entity or a TNF-α binding entity and the second antibody comprises the other.

Additionally or alternatively, correct heavy-light chain pairing may be facilitated by swapping the CH1 and CL domains in the carboxyl-terminal Fab binding domain. By way of example, the first polypeptide, which is fused to the carboxyl terminus of the heavy chain, may comprise a VL domain and CH1 domain from the second antibody, and the second polypeptide may comprise a VH domain and CL domain from the second antibody. In another embodiment, the first polypeptide, which is fused to the carboxyl terminus of the heavy chain, may comprise a VH domain and a CL domain from the second antibody, and the second polypeptide may comprise a VL domain and CH1 domain from the second antibody.

The heavy chain constant regions or the Fc regions of the bispecific antigen binding proteins described herein may comprise one or more amino acid substitutions that affect the glycosylation and/or effector function of the antigen binding protein. One of the functions of the Fc region of an immunoglobulin is to communicate to the immune system when the immunoglobulin binds its target. This is commonly referred to as "effector function." Communication leads to antibody-dependent cellular cytotoxicity (ADCC), antibody-dependent cellular phagocytosis (ADCP), and/or complement dependent cytotoxicity (CDC). ADCC and ADCP are mediated through the binding of the Fc region to Fc receptors on the surface of cells of the immune system. CDC is mediated through the binding of the Fc with proteins of the complement system, e.g., C1q. In some embodiments, the bispecific antigen binding proteins of the invention comprise one or more amino acid substitutions in the constant region to enhance effector function, including ADCC activity, CDC activity, ADCP activity, and/or the clearance or half-life of the antigen binding protein. Exemplary amino acid substitutions (EU numbering) that can enhance effector function include, but are not limited to, E233L, L234I, L234Y, L235S, G236A, S239D, F243L, F243V, P247I, D280H, K290S, K290E, K290N, K290Y, R292P, E294L, Y296W, S298A, S298D, S298V, S298G, S298T, T299A, Y300L, V305I, Q311M, K326A, K326E, K326W, A330S, A330L, A330M, A330F, I332E, D333A, E333S, E333A, K334A, K334V, A339D, A339Q, P396L, or combinations of any of the foregoing.

In other embodiments, the bispecific antigen binding proteins of the invention comprise one or more amino acid substitutions in the constant region to reduce effector function. Exemplary amino acid substitutions (EU numbering) that can reduce effector function include, but are not limited to, C220S, C226S, C229S, E233P, L234A, L234V, V234A, L234F, L235A, L235E, G237A, P238S, S267E, H268Q, N297A, N297G, V309L, E318A, L328F, A330S, A331S, P331S or combinations of any of the foregoing.

Exemplary substitutions to aid in correct assembly of hetero Ig molecules are shown in FIG. 1. Preferred substitutions for the hetero Ig format are shown in (v2) in FIG. 1 and Table N. All positions in Table N are according to EU numbering.

TABLE N

Mutations in the hetero-Ig Molecules

| Chain | Domain | Mutation | EU # |
|---|---|---|---|
| Light chain 1 | Variable | E | 38 |
| | Constant | E | 176 |
| Light chain 2 | Variable | K | 38 |
| | Constant | K | 176 |
| Heavy chain 1 | Variable | K | 39 |
| | CH1 | K | 183 |
| | CH3 | D | 392 |
| | CH3 | D | 409 |
| Heavy chain 2 | Variable | E | 39 |
| | CH1 | E | 183 |
| | CH3 | K | 356 |
| | CH3 | K | 399 |

Figure 25:
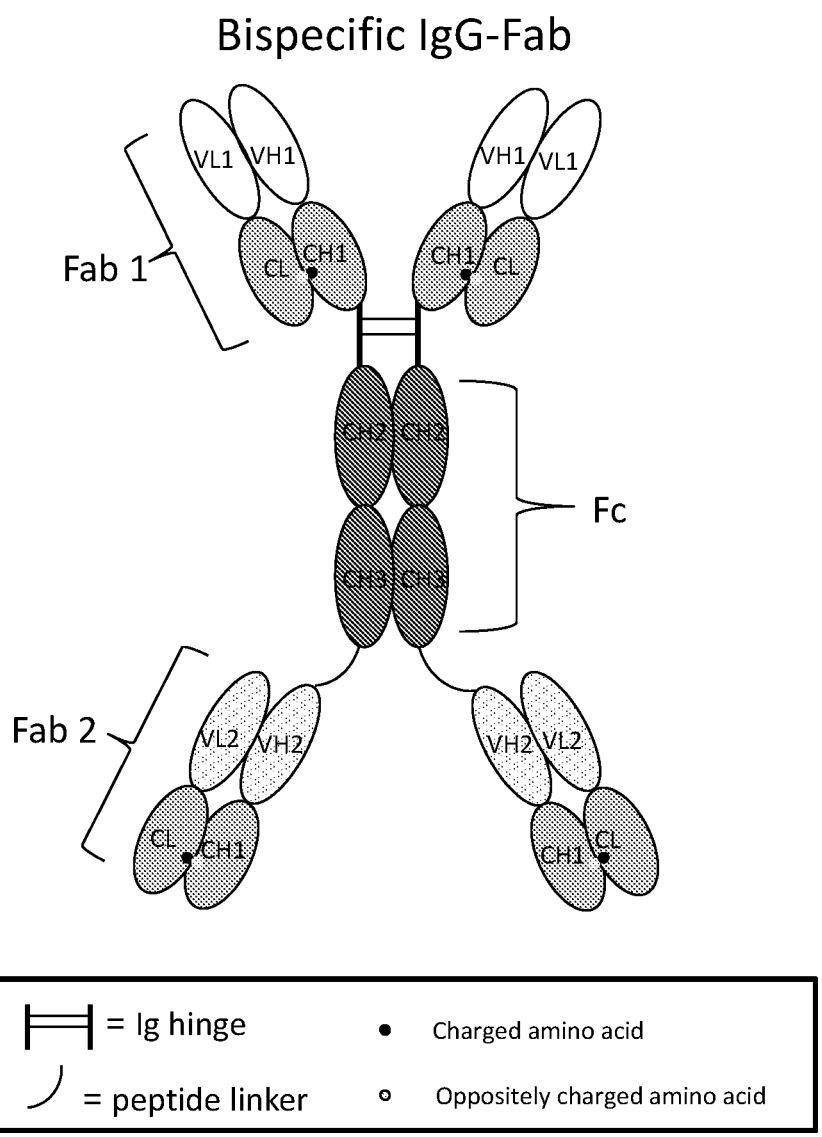
FIG. 25 depicts a schematic representation of a bispecific IgG-Fab format for an anti-TL1A anti-TNF-α bispecific antigen binding protein within the present invention. In this format, one polypeptide chain of a Fab fragment from a second antibody (e.g. the heavy chain (VH2-CH1) is fused to the carboxyl terminus of each heavy chain of a first antibody through a peptide linker to produce a modified heavy chain. The complete molecule is a homohexamer comprising two modified heavy chains, two light chains from the first antibody, and two polypeptide chains containing the other half of the Fab fragment from the second antibody (e.g. the light chain (VL2-CL)). Charge pair mutations (represented by the circles) can be introduced into the Fab regions of the first antibody (Fab 1) and/or second antibody (Fab 2) to promote correct heavy chain-light chain pairing.
Figure 26:
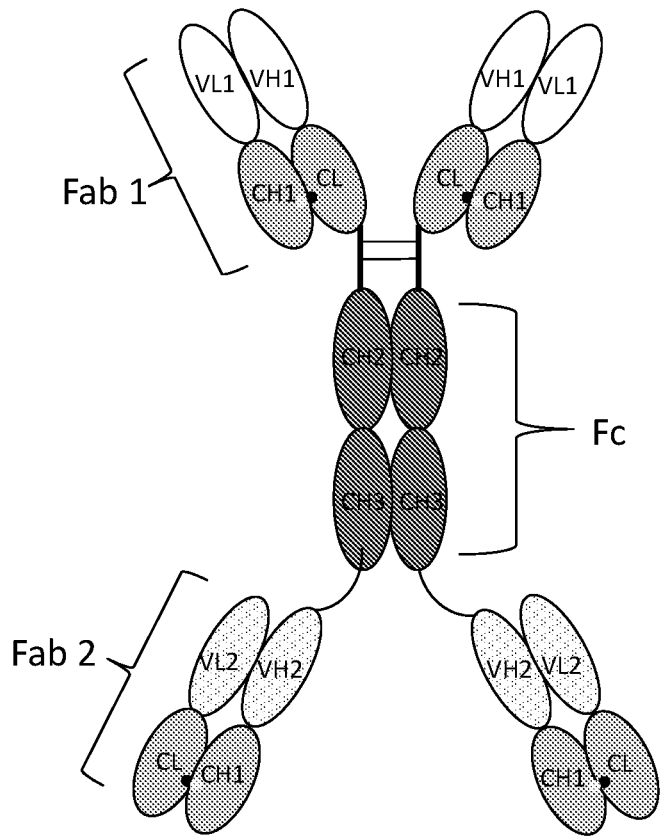
FIG. 26 depicts a schematic representation of a bispecific IgG-Fab format for an anti-TL1A anti-TNF-α bispecific antigen binding protein within the present invention using immunoglobulin domain crossover. In this variation of the IgG-Fab format, one polypeptide chain of a Fab fragment from a second antibody (e.g. the heavy chain (VH2-CH1) is fused to the carboxyl terminus of the heavy chain comprising a CL instead of a CH1 domain of a first antibody through a peptide linker to produce a modified heavy chain. In this way, the CH1 and the CL domains of Fab 1 are "swapped." This swap is referred to as a Fab1 swap or an N-terminal swap herein. The complete molecule is a homohexamer comprising two modified heavy chains, two light chains from the first antibody comprising a CH1 domain instead of a CL domain, and two polypeptide chains containing the other half of the Fab fragment from the second antibody (e.g. the light chain (VL2-CL)). Charge pair mutations (represented by the circles) can be introduced into the Fab regions of the first antibody (Fab 1) and/or second antibody (Fab 2) to promote correct heavy chain-light chain pairs. Not shown but also within the scope of this invention are IgG-Fab molecules in which (i) the CH1 and CL domains of Fab 2 are swapped instead of those of Fab 1 (referred to herein as a Fab 2 swap or a C-terminal swap) or (ii) both the CH1 and CL domains of Fab 1 are swapped and the CH1 and CL domains of Fab 2 are swapped (referred to herein as a dual swap).
Figure 27:
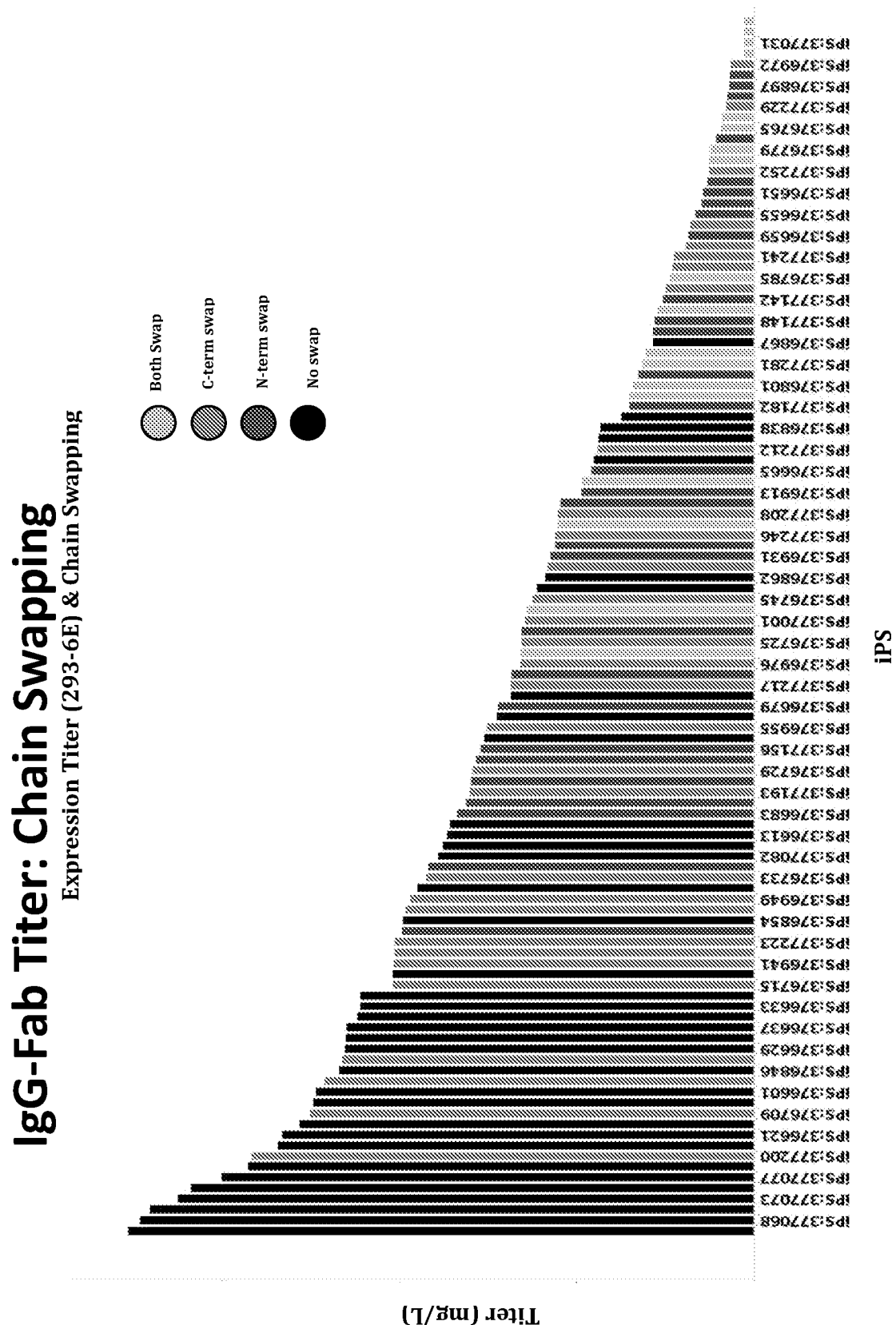
FIG. 27 compares the expression titer of IgG-Fabs based on domain swapping format.
Figure 28:
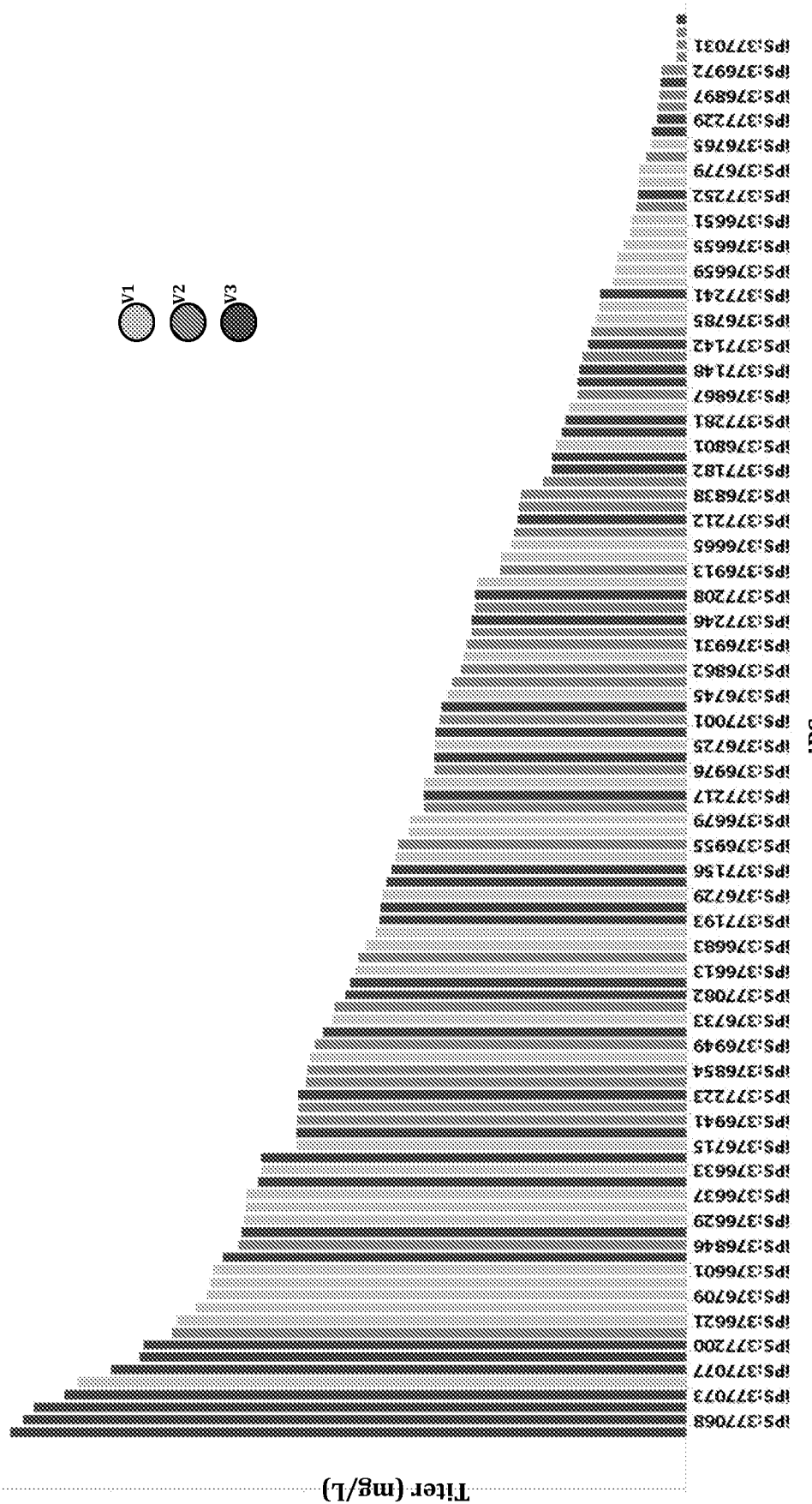
FIG. 28 compares the expression titer of IgG-Fabs based on type of charge pair mutation(s).
Figure 29:
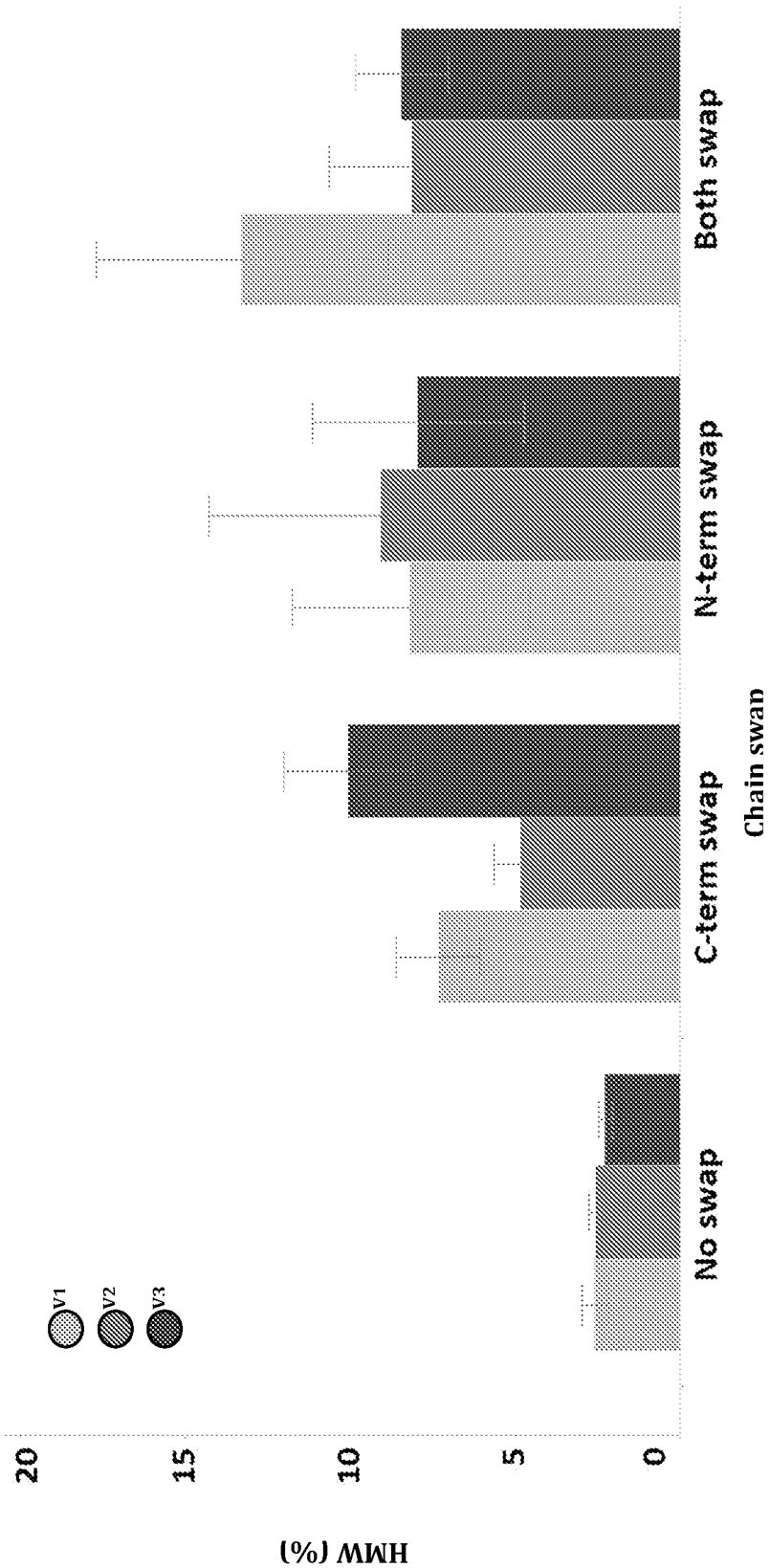
FIG. 29 compares the purity of IgG-Fabs based on domain swapping format.
Figure 30:
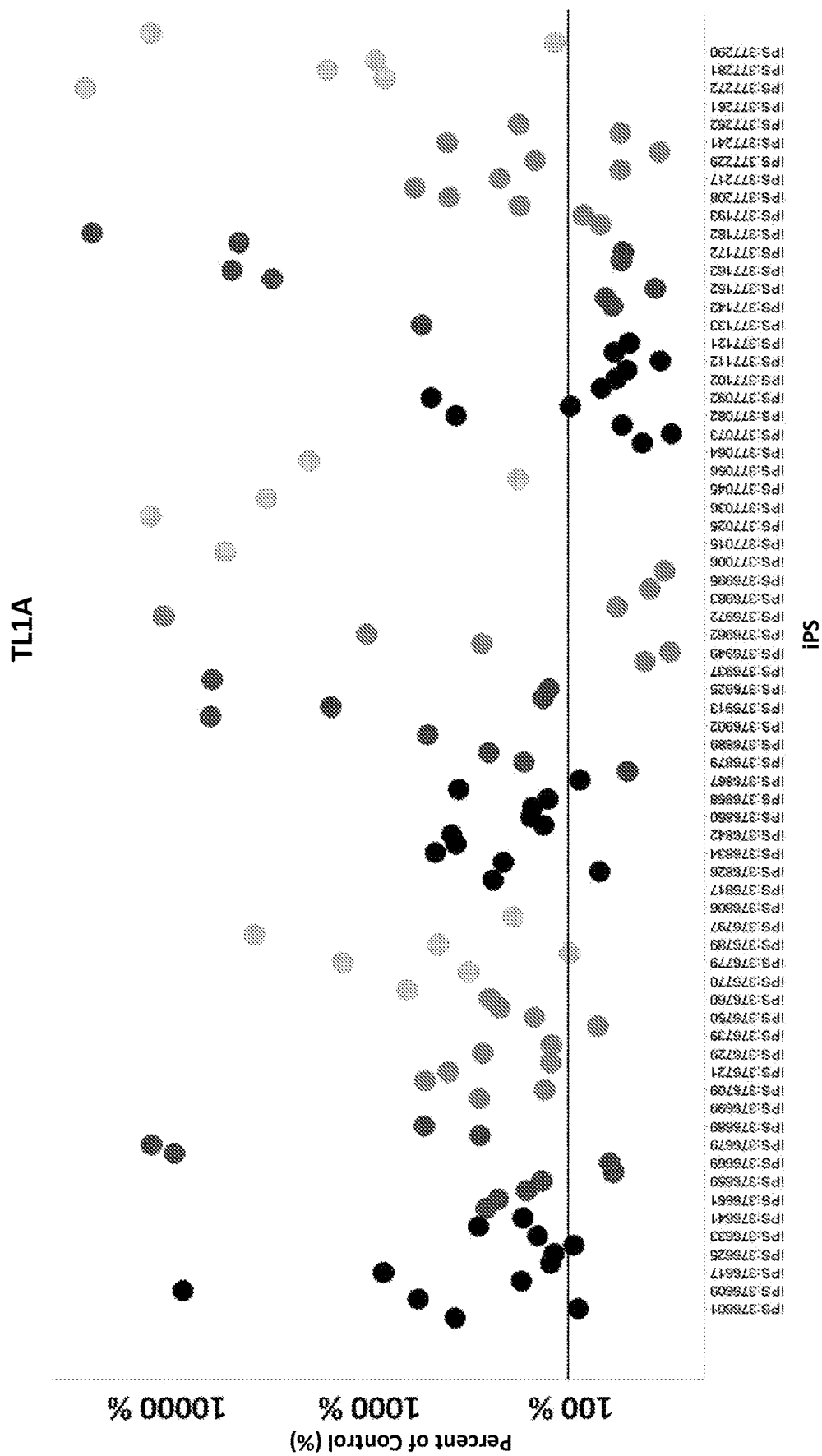
FIG. 30 compares the anti-TL1A potency of IgG-Fabs based on domain swapping format.
Figure 31:
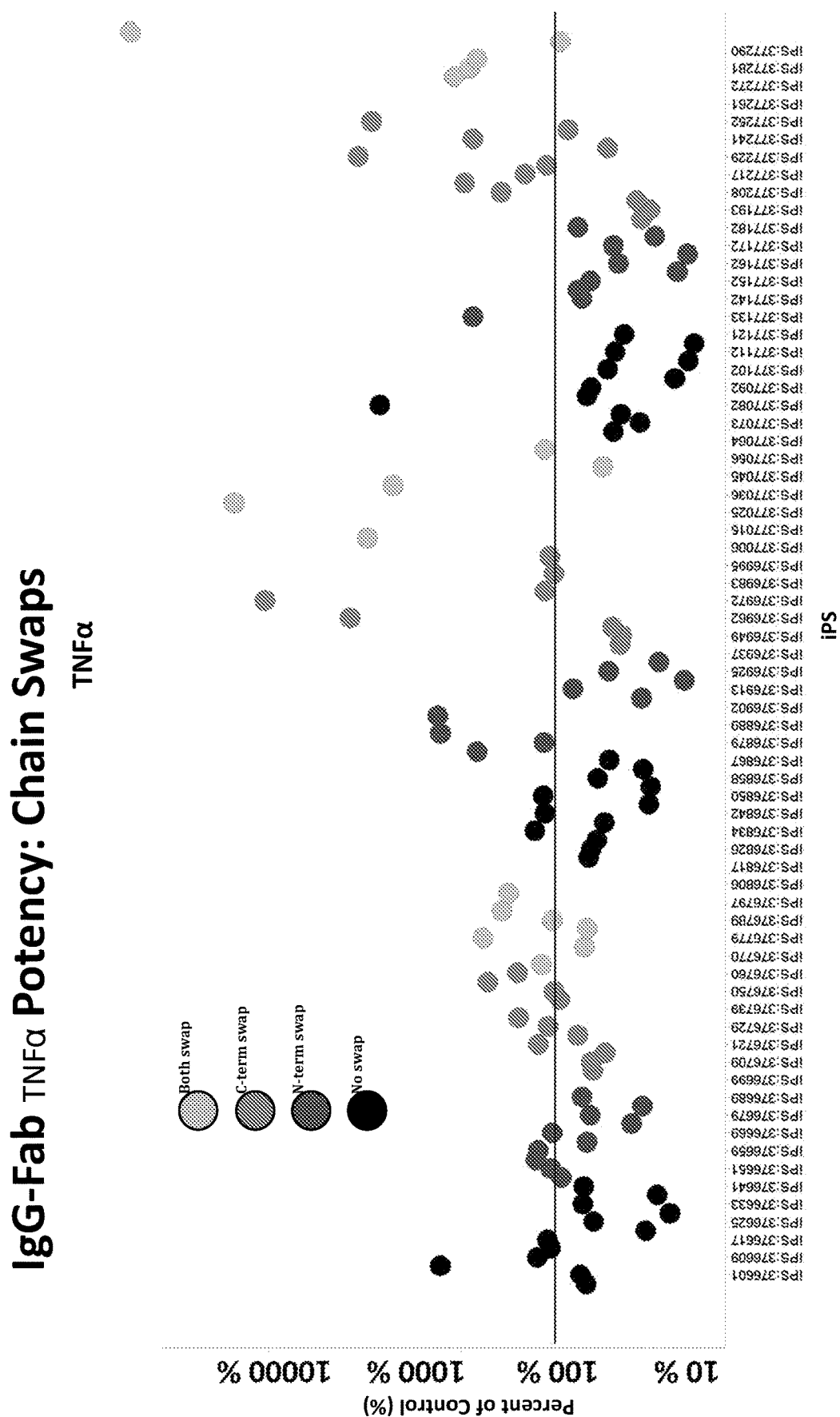
FIG. 31 compares the anti-TNF-α potency of IgG-Fabs based on domain swapping format.
Figure 32:
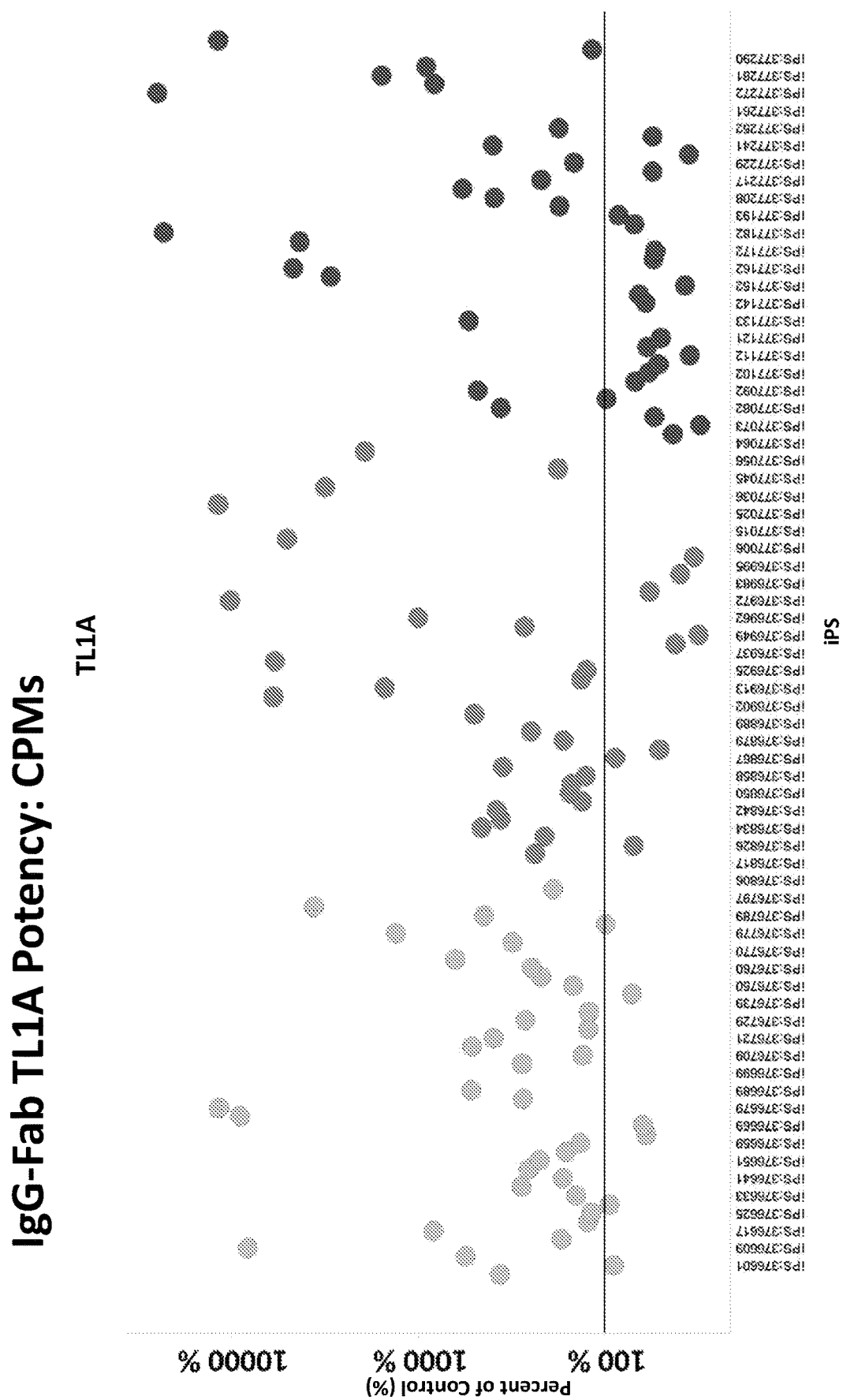
FIG. 32 compares the anti-TL1A potency of IgG-Fabs based on type of charge pair mutation(s).
Figure 33:
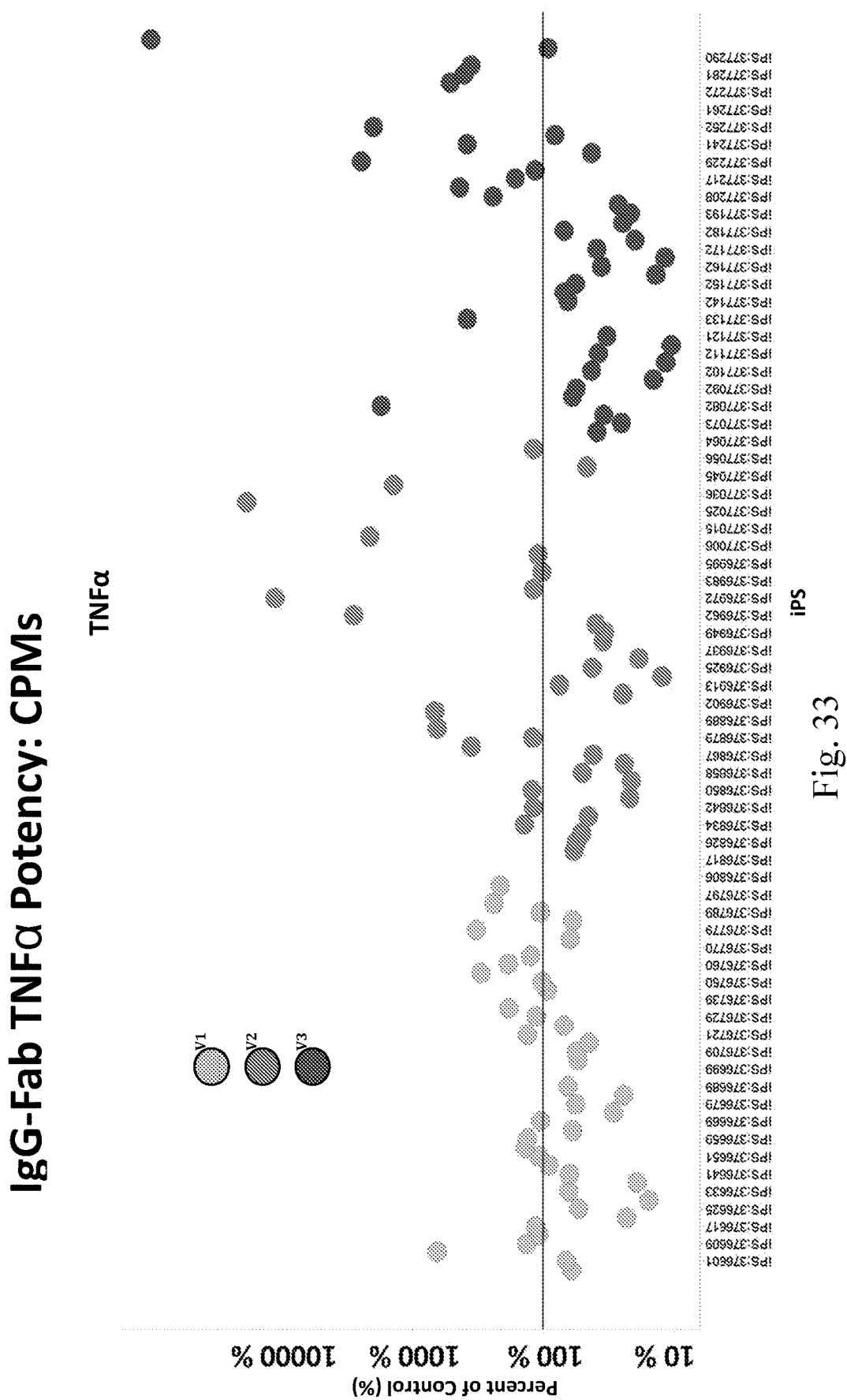
FIG. 33 compares the anti-TNF-α potency of IgG-Fabs based on type of charge pair mutation(s).

Preferred charged amino acids for the IgG-Fab format, as well as CH/CL domain swaps as described herein for FIG. 26, are shown in Table O. "Fab 1" and "Fab 2" in Table O are as depicted in FIGS. 25 and 26. Fab 1 is at the N-terminus of the IgG-Fab molecule and Fab 2 is at its C-terminus. The identity and position of the charged amino acids in the Fab appear to the right of the domain listed in Table O. All positions are according to EU numbering.

TABLE O

Mutations in the IgG-Fab Molecules

| Designation | Domain | Mutation | EU # | Domain | Mutation | EU # |
|---|---|---|---|---|---|---|
| CPMv1 | Fab 1 CL | E | 230 | Fab 2 CL | K | 230 |
| | Fab 1 CH1 | K | 230 | Fab 2 CH1 | E | 230 |
| CPMv1 Fab 1 swap | Fab 1 CL | K | 230 | Fab 2 CL | K | 230 |
| | Fab 1 CH1 | E | 230 | Fab 2 CH1 | E | 230 |
| CPMv1 Fab 2 swap | Fab 1 CL | E | 230 | Fab 2 CL | E | 230 |
| | Fab 1 CH1 | K | 230 | Fab 2 CH1 | K | 230 |
| CPMv1 Fab 1&2 swap | Fab 1 CL | K | 230 | Fab 2 CL | E | 230 |
| | Fab 1 CH1 | E | 230 | Fab 2 CH1 | K | 230 |
| CPMv2 | Fab 1 CL | E | 230 | Fab 2 CL | K | 230 |
| | Fab 1 CH1 | K | 230 | Fab 2 CH1 | E | 230 |
| | Fab 1 VL | E | 46 | Fab 2 VL | E | 46 |
| | Fab 1 VH | K | 46 | Fab 2 VH | K | 46 |
| CPMv2 Fab 1 swap | Fab 1 CL | K | 230 | Fab 2 CL | K | 230 |
| | Fab 1 CH1 | E | 230 | Fab 2 CH1 | E | 230 |
| | Fab 1 VL | E | 46 | Fab 2 VL | E | 46 |
| | Fab 1 VH | K | 46 | Fab 2 VH | K | 46 |
| CPMv2 Fab 2 swap | Fab 1 CL | E | 230 | Fab 2 CL | E | 230 |
| | Fab 1 CH1 | K | 230 | Fab 2 CH1 | K | 230 |
| | Fab 1 VL | E | 46 | Fab 2 VL | E | 46 |
| | Fab 1 VH | K | 46 | Fab 2 VH | K | 46 |

TABLE O-continued

Mutations in the IgG-Fab Molecules

| Designation | Domain | Mutation | EU # | Domain | Mutation | EU # |
|---|---|---|---|---|---|---|
| CPMv2 | Fab 1 CL | K | 230 | Fab 2 CL | E | 230 |
| Fab 1 & 2 swap | Fab 1 CH1 | E | 230 | Fab 2 CH1 | K | 230 |
|  | Fab 1 VL | E | 46 | Fab 2 VL | E | 46 |
|  | Fab 1 VH | K | 46 | Fab 2 VH | K | 46 |
| CPMv3 | Fab 1 CL | E | 230 | Fab 2 CL | K | 230 |
|  | Fab 1 CH1 | K | 230 | Fab 2 CH1 | E | 230 |
|  | Fab 1 VL | E | 141 | Fab 2 VL | E | 51 |
|  | Fab 1 VH | K | 51 | Fab 2 VH | K | 141 |
| CPMv3 Fab 1 swap | Fab 1 CL | K | 230 | Fab 2 CL | K | 230 |
|  | Fab 1 CH1 | E | 230 | Fab 2 CH1 | E | 230 |
|  | Fab 1 VL | E | 141 | Fab 2 VL | E | 51 |
|  | Fab 1 VH | K | 51 | Fab 2 VH | K | 141 |
| CPMv3 Fab 2 swap | Fab 1 CL | E | 230 | Fab 2 CL | E | 230 |
|  | Fab 1 CH1 | K | 230 | Fab 2 CH1 | K | 230 |
|  | Fab 1 VL | E | 141 | Fab 2 VL | E | 51 |
|  | Fab 1 VH | K | 51 | Fab 2 VH | K | 141 |
| CPMv3 Fab 1 & 2 swap | Fab 1 CL | K | 230 | Fab 2 CL | E | 230 |
|  | Fab 1 CH1 | E | 230 | Fab 2 CH1 | K | 230 |
|  | Fab 1 VL | E | 141 | Fab 2 VL | E | 51 |
|  | Fab 1 VH | K | 51 | Fab 2 VH | K | 141 |

Binding Affinity and Biological Activity

In another embodiment of the foregoing aspects of the invention, an anti-TL1A antibody (or an antigen-binding fragment thereof) or the TL1A binding entity of a hetero Ig bispecific antigen binding protein or an IgG-scFv antigen binding protein binds TL1A with a binding affinity ($K_{D1}$) of at least $1\times10^{-10}$ M$^{-1}$, at least $5\times10^{-10}$ M$^{-1}$, at least $1\times10^{-10}$ M$^{-1}$, at least $5\times10^{-10}$ M$^{-1}$, at least $8\times10^{-10}$ M$^{-1}$, or at least $1\times10^{-10}$ M$^{-1}$ wherein the binding affinity is measured by surface plasmon resonance, such as Biacore. More particularly, the invention relates to the following embodiments:

an anti-TL1A antibody (or an antigen-binding fragment thereof) binds to human TL1A when the antibody is immobilized on an SCM5 sensor chip at a binding affinity of about 1 to about 5 KD pM or to cynomolgus TL1A when the antibody is immobilized on an SCM5 sensor chip at a binding affinity of about $1^{-10}$ to about $7.5^{-10}$ M$^{-1}$ KD;

an anti-TNF-α binding entity of a hetero Ig bispecific antigen binding protein binds to human TNF-α when the antigen binding protein is immobilized on an SCM5 sensor chip at a binding affinity of about $1^{-10}$ to about $5^{-10}$ M$^{-1}$ KD pM, preferably about 10 to about 12 pM;

an anti-TL1A binding entity of a hetero Ig bispecific antigen binding protein binds to human TL1A when the antigen binding protein is immobilized on an SCM5 sensor chip at a binding affinity of about $2^{-10}$ to about $6.5^{-10}$ M$^{-1}$ KD, preferably about 10 to about 11 PM;

an anti-TNF-α binding entity of an IgG-scFv bispecific antigen binding protein binds to human TNF-α when the antigen binding protein is immobilized on an SCM5 sensor chip at a binding affinity of about $4.5^{-10}$ to about $7.5^{-10}$ M$^{-1}$ KD, preferably about 10 to about 20 pM; and a TL1A binding entity of an IgG-scFv bispecific antigen binding protein binds to human TL1A when the antigen binding protein is immobilized on an SCM5 sensor chip at a binding affinity of about 1.5 to about 160 pM KD.

Further details on TL1A and TNF-α binding appear in Examples 13 and 15 hereinafter.

In another embodiment of the foregoing aspects of the invention, a TNF-α binding entity of an IgG-Fab bispecific antigen binding protein binds a TNF-α trimer with a binding affinity ($K_{D1}$) of $1\times10^{-10}$ M$^{-1}$, at least $5\times10^{-10}$ M$^{-1}$, at least $1\times10^{-10}$ M$^{-1}$, at least $5\times10^{-10}$ M$^{-1}$, at least $8\times10^{-10}$ M$^{-1}$, or at least $1\times10^{-10}$ M$^{-1}$ wherein the binding affinity is measured by surface plasmon resonance, such as Biacore.

In other embodiments of the foregoing aspects of the invention:

an anti-TL1A antibody (or an antigen-binding fragment thereof) neutralizes or inhibits human TL1A in a TF-1 NF-κB reporter cell line with an IC$_{50}$ of about 0.08 to about 3 nM, cynomolgus TL1A TL1A in a TF-1 NF-κB reporter cell line with an IC$_{50}$ of about 0.375 to about 10 nM;

a TNF-α binding entity of a hetero Ig bispecific antigen binding protein neutralizes or inhibits human TNF-α in a TF-1 NF-κB reporter cell line with an IC$_{50}$ of about 50 to 550 pM, with about 50 to about 110 pM preferred;

a TL1A binding entity of a hetero Ig bispecific antigen binding protein neutralizes or inhibits human TL1A in a TF-1 NF-κB reporter cell line with an IC$_{50}$ of about 45 to about 3500 pM, with about 45 to 190 pM preferred;

a TNF-α binding entity of an IgG-scFv bispecific antigen binding protein neutralizes or inhibits soluble human TNF-α in a TF-1 NF-κB reporter cell line with an IC$_{50}$ of about 20 to about 75 pM; and a TL1A binding entity of an IgG-scFv bispecific antigen binding protein neutralizes or inhibits human TL1A in a TF-1 NF-κB reporter cell line with an IC$_{50}$ of about 19 to about 200 pM.

Further details on TL1A inhibition and TNF-α inhibition appears in Examples 14 and 16 hereinafter.

Immunoconjugates, Derivatives, Variants

The antibodies and bispecific antibodies of the invention may be used alone or as immunoconjugates with a therapeutic agent (e.g., a cytotoxic agent). In some embodiments, the agent is a chemotherapeutic agent. In some embodiments, the agent is a radioisotope, including but not limited to Lead-212, Bismuth-212, Astatine-211, Iodine-131, Scandium-47, Rhenium-186, Rhenium-188, Yttrium-90, Iodine-123, Iodine-125, Bromine-77, Indium-111, and fissionable nuclides such as Boron-10 or an Actinide. In other embodiments, the agent is a toxin or cytotoxic drug, including but not limited to ricin, abrin, modified *Pseudomonas* enterotoxin A, *Pseudomonas* exotoxin, calicheamicin, adriamycin, 5-fluorouracil, diphtheria toxin, and the like. Methods of conjugation of antibodies to such agents are known in the literature, and include direct and indirect conjugation.

Suitable detectable molecules may be directly or indirectly attached to the antibodies and bispecific antibodies of the present invention. Suitable detectable molecules include radionuclides, enzymes, substrates, cofactors, inhibitors, fluorescent markers, chemiluminescent markers, magnetic particles and the like. For indirect attachment of a detectable or cytotoxic molecule, the detectable or cytotoxic molecule can be conjugated with a member of a complementary/anti-complementary pair, where the other member is bound to the binding polypeptide or antibody portion. For these purposes, biotin/streptavidin is an exemplary complementary/anti-complementary pair.

The bispecific antibodies and antibodies of the invention also include derivatives that are modified, e.g., by the covalent attachment of any type of molecule to the antibody such that covalent attachment does not prevent the antibody from binding to its epitope. Examples of suitable derivatives include but are not limited to antibodies or bispecific antibodies that are fucosylated, glycosylated, acetylated, pegylated, phosphorylated, or amidated. The antibodies and bispecific antibodies and derivatives thereof of the invention may themselves by derivatized by known protecting/blocking groups, proteolytic cleavage, linkage to a cellular ligand or other proteins, and the like. In some embodiments of the invention, at least one heavy chain of the antibody or bispecific antigen binding protein is PEGylated. In some embodiments, the PEGylation is N-linked or is linked through the sidechain of an amino acid (e.g., lysine).

Glycosylation can contribute to the effector function of antibodies, particularly IgG1 antibodies. Thus, in some embodiments, the antigen binding proteins of the invention may comprise one or more amino acid substitutions that affect the level or type of glycosylation of the binding proteins. Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

In certain embodiments, glycosylation of the antigen binding proteins described herein is increased by adding one or more glycosylation sites, e.g., to the Fc region of the binding protein. Addition of glycosylation sites to the antigen binding protein can be conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antigen binding protein amino acid sequence may be altered through changes at the DNA level, particularly by mutating the DNA encoding the target polypeptide at preselected bases such that codons are generated that will translate into the desired amino acids.

The invention also encompasses production of antigen binding proteins with altered carbohydrate structure resulting in altered effector activity, including antigen binding proteins with absent or reduced fucosylation that exhibit improved ADCC activity. Various methods are known in the art to reduce or eliminate fucosylation. For example, ADCC effector activity is mediated by binding of the antibody molecule to the FcγRIII receptor, which has been shown to be dependent on the carbohydrate structure of the N-linked glycosylation at the N297 residue of the CH2 domain. Non-fucosylated antibodies bind this receptor with increased affinity and trigger FcγRIII-mediated effector functions more efficiently than native, fucosylated antibodies. For example, recombinant production of non-fucosylated antibody in CHO cells in which the alpha-1,6-fucosyl transferase enzyme has been knocked out results in antibody with 100-fold increased ADCC activity (see Yamane-Ohnuki et al., Biotechnol Bioeng. 87(5):614-22, 2004). Similar effects can be accomplished through decreasing the activity of alpha-1,6-fucosyl transferase enzyme or other enzymes in the fucosylation pathway, e.g., through siRNA or antisense RNA treatment, engineering cell lines to knockout the enzyme(s), or culturing with selective glycosylation inhibitors (see Rothman et al., Mol Immunol. 26(12):1113-23, 1989). Some host cell strains, e.g. Lec13 or rat hybridoma YB2/0 cell line naturally produce antibodies with lower fucosylation levels (see Shields et al., J Biol Chem. 277(30):26733-40, 2002 and Shinkawa et al., J Biol Chem. 278(5):3466-73, 2003). An increase in the level of bisected carbohydrate, e.g. through recombinantly producing antibody in cells that overexpress GnTIII enzyme, has also been determined to increase ADCC activity (see Umana et al., Nat Biotechnol. 17(2):176-80, 1999).

In other embodiments, glycosylation of the antigen binding proteins described herein is decreased or eliminated by removing one or more glycosylation sites, e.g., from the Fc region of the binding protein. Amino acid substitutions that eliminate or alter N-linked glycosylation sites can reduce or eliminate N-linked glycosylation of the antigen binding protein. In certain embodiments, the bispecific antigen binding proteins described herein comprise a mutation at position N297 (EU numbering), such as N297Q, N297A, or N297G. In one particular embodiment, the bispecific antigen binding proteins of the invention comprise a Fc region from a human IgG1 antibody with a N297G mutation. To improve the stability of molecules comprising a N297 mutation, the Fc region of the molecules may be further engineered. For instance, in some embodiments, one or more amino acids in the Fc region are substituted with cysteine to promote disulfide bond formation in the dimeric state. Residues corresponding to V259, A287, R292, V302, L306, V323, or I332 (EU numbering) of an IgG1 Fc region may thus be substituted with cysteine. In one embodiment, specific pairs of residues are substituted with cysteine such that they preferentially form a disulfide bond with each other, thus limiting or preventing disulfide bond scrambling. In certain embodiments pairs include, but are not limited to, A287C and L306C, V259C and L306C, R292C and V302C, and V323C and I332C. In particular embodiments, the bispecific antigen binding proteins described herein comprise a Fc region from a human IgG1 antibody with mutations at R292C and V302C. In such embodiments, the Fc region may also comprise a N297G mutation.

Modifications of the antigen binding proteins of the invention to increase serum half-life also may desirable, for example, by incorporation of or addition of a salvage receptor binding epitope (e.g., by mutation of the appropriate region or by incorporating the epitope into a peptide tag that is then fused to the antigen binding protein at either end or in the middle, e.g., by DNA or peptide synthesis; see, e.g., WO96/32478) or adding molecules such as PEG or other water soluble polymers, including polysaccharide polymers. The salvage receptor binding epitope preferably constitutes a region wherein any one or more amino acid residues from one or two loops of a Fc region are transferred to an analogous position in the antigen binding protein. In one embodiment, three or more residues from one or two loops of the Fc region are transferred. In one embodiment, the epitope is taken from the CH2 domain of the Fc region (e.g., an IgG Fc region) and transferred to the CH1, CH3, or VH region, or more than one such region, of the antigen binding protein. Alternatively, the epitope is taken from the CH2 domain of the Fc region and transferred to the CL region or VL region, or both, of the antigen binding protein. See International applications WO 97/34631 and WO 96/32478 for a description of Fc variants and their interaction with the salvage receptor.

The bispecific antibodies and antibodies of the invention include variants having single or multiple amino acid substitutions, deletions, additions, or replacements that retain their biological properties (e.g., blocking the binding of TL1A and/or TNF-α to their respective receptors, inhibiting the biological activity of TL1A and TNF-α). A person of ordinary skill in the art can produce variants having single or multiple amino acid substitutions, deletions, additions or replacements. These variants may include, inter alia: (a) variants in which one or more amino acid residues are substituted with conservative or non-conservative amino acids, (b) variants in which one or more amino acids are added to or deleted from the polypeptide, (c) variants in which one or more amino acids include a substituent group, and (d) variants in which the polypeptide is fused with another peptide or polypeptide such as a fusion partner, a protein tag or other chemical moiety, that may confer useful properties to the polypeptide, such as, for example, an epitope for an antibody, a polyhistidine sequence, a biotin moiety and the like. Antibodies and bispecific antibodies of the invention may include variants in which amino acid residues from one species are substituted for the corresponding residue in another species, either at the conserved or non-conserved positions. In another embodiment, amino acid residues at non-conserved positions are substituted with conservative or non-conservative residues. The techniques for obtaining these variants, including genetic (suppressions, deletions, mutations, etc.), chemical, and enzymatic techniques, are known to the person having ordinary skill in the art.

Nucleic Acids, Vectors, Host Cells

The invention also includes isolated nucleic acids encoding the bispecific antibodies of the invention, which includes, for instance, the light chain, light chain variable region, light chain constant region, heavy chain, heavy chain variable region, heavy chain constant region, linkers, and any and all components and combinations thereof of the bispecific antibodies disclosed herein. Nucleic acids of the invention include nucleic acids having at least 80%, more preferably at least about 90%, more preferably at least about 95%, and most preferably at least about 98% homology to nucleic acids of the invention. The terms "percent similarity", "percent identity" and "percent homology" when referring to a particular sequence are used as set forth in the University of Wisconsin GCG® software program. Nucleic acids of the invention also include complementary nucleic acids. In some instances, the sequences will be fully complementary (no mismatches) when aligned. In other instances, there may be up to about a 20% mismatch in the sequences.

In some embodiments of the invention are provided nucleic acids encoding both a heavy chain and a light chain of an antibody of the invention.

Nucleic acids of the invention can be cloned into a vector, such as a plasmid, cosmid, bacmid, phage, artificial chromosome (BAC, YAC) or virus, into which another genetic sequence or element (either DNA or RNA) may be inserted so as to bring about the replication of the attached sequence or element. In some embodiments, the expression vector contains a constitutively active promoter segment (such as but not limited to CMV, SV40, Elongation Factor or LTR sequences) or an inducible promoter sequence such as the steroid inducible pIND vector (Invitrogen), where the expression of the nucleic acid can be regulated. Expression vectors of the invention may further comprise regulatory sequences, for example, an internal ribosomal entry site. The expression vector can be introduced into a cell by transfection, for example.

For IgG-Fab bispecific antigen binding proteins, nucleic acids encoding each of the three components may be cloned into the same expression vector. In some embodiments, the nucleic acid encoding the light chain of the IgG-Fab molecule and the nucleic acid encoding the second polypeptide (which comprises the other half of the C-terminal Fab domain) are cloned into one expression vector, whereas the nucleic acid encoding the modified heavy chain (fusion protein comprising a heavy chain and half of a Fab domain) is cloned into a second expression vector. In certain embodiments, all components of the bispecific antigen binding proteins described herein are expressed from the same host cell population. For example, even if one or more components is cloned into a separate expression vector, the host cell is co-transfected with both expression vectors such that one cell produces all components of the bispecific antigen binding proteins.

In another embodiment, the present invention provides an expression vector comprising the following operably linked elements; a transcription promoter; a first nucleic acid molecule encoding the heavy chain of a bispecific antigen binding protein, antibody or antigen-binding fragment of the invention; a second nucleic acid molecule encoding the light chain of a bispecific antigen binding protein, antibody or antigen-binding fragment of the invention; and a transcription terminator. In another embodiment, the present invention provides an expression vector comprising the following operably linked elements; a first transcription promoter; a first nucleic acid molecule encoding the heavy chain of a bispecific antigen binding protein, antibody or antigen-binding fragment of the invention; a first transcription terminator; a second transcription promoter a second nucleic acid molecule encoding the light chain of a bispecific antigen binding protein, antibody or antigen-binding fragment of the invention; and a second transcription terminator.

A secretory signal peptide sequence can also, optionally, be encoded by the expression vector, operably linked to the coding sequence of interest, so that the expressed polypeptide can be secreted by the recombinant host cell, for more facile isolation of the polypeptide of interest from the cell, if desired. For instance, in some embodiments, signal peptide sequences may be appended/fused to the amino terminus of any of the polypeptide sequences listed in Tables E, J, K, and L. In certain embodiments, a signal peptide having the amino acid sequence of MKHLWFFLLLVAAPRWVLS (SEQ ID NO: 499) is fused to the amino terminus of any of the polypeptide sequences in Tables D, I, J, and K. In other embodiments, a signal peptide having the amino acid sequence of METPAQLLFLLLLWLPDTTG (SEQ ID NO:

501) is fused to the amino terminus of any of the polypeptide sequences in Tables E, J, K, and L. In still other embodiments, a signal peptide having the amino acid sequence of MDMRVPAQLLGLLLLWLRGARC (SEQ ID NO: 503) is fused to the amino terminus of any of the polypeptide sequences in Tables E, J, K, and L. Each of the foregoing signal peptides is encoded by the nucleic acid having a sequence immediately preceding it in the Sequence Listing. Other suitable signal peptide sequences that can be fused to the amino terminus of the polypeptide sequences described herein include: MEAPAQLLFLLLLWLPDTTG (SEQ ID NO: 504), MEWTWRVLFLVAAATGAHS (SEQ ID NO: 505), and MEWS WVFLFFLSVTTGVHS (SEQ ID NO: 506). Other signal peptides are known to those of skill in the art and may be fused to any of the polypeptide chains listed in Tables E, J, K and L, for example, to facilitate or optimize expression in particular host cells.

Recombinant host cells comprising such vectors and expressing the heavy and light chains are also provided.

Antibody-producing cells and bispecific antigen binding protein producing cells contain, depending on the bispecific antigen binding protein format, nucleic acids encoding the heavy chain, light chain, heavy chain-scFv construct, heavy chain-Fab heavy chain variable domain construct, and Fab light chain variable domain. Such nucleic acids can be used to produce the antibodies or bispecific antibodies of the invention in accordance with techniques known in the art. The present invention, in one embodiment, provides a method of producing a bispecific antigen binding protein or antibody comprising culturing a recombinant host cell expressing the heavy and light chains or other constructs noted above and isolating the bispecific antigen binding protein or antibody produced by the cell.

The recombinant host cell may be a prokaryotic cell, for example an *E. coli* cell, or a eukaryotic cell, for example a mammalian cell or a yeast cell. Yeast cells include *Saccharomyces cerevisiae*, *Schizosaccharomyces pombe*, and *Pichia pastoris* cells. Mammalian cells include VERO, HeLa, Chinese hamster Ovary (CHO), W138, baby hamster kidney (BHK), COS-7, MDCK, human embryonic kidney line 293, normal dog kidney cell lines, normal cat kidney cell lines, monkey kidney cells, African green monkey kidney cells, COS cells, and non-tumorigenic mouse myoblast G8 cells, fibroblast cell lines, myeloma cell lines, mouse NIH/3T3 cells, LMTK31 cells, mouse sertoli cells, human cervical carcinoma cells, buffalo rat liver cells, human lung cells, human liver cells, mouse mammary tumor cells, TRI cells, MRC 5 cells, and FS4 cells. Antibody-producing and bispecific antigen binding protein-producing cells of the invention also include any insect expression cell line known, such as for example, *Spodoptera frugiperda* cells. In a preferred embodiment, the cells are mammalian cells. In a most preferred embodiment, the mammalian cells are CHO cells.

The antibody-producing cells preferably are substantially free of TL1A and TNF-α binding competitors. In preferred embodiments, the antibody-producing cells comprise less than about 10%, preferably less than about 5%, more preferably less than about 1%, more preferably less than about 0.5%, more preferably less than about 0.1%, and most preferably 0% by weight TL1A or TNF-α binding competitors. In some embodiments, the antibodies and bispecific antibodies produced are substantially free of TL1A and TNF-α competitors. In preferred embodiments, the antibodies and bispecific antibodies produced comprise less than about 10%, preferably less than about 5%, more preferably less than about 1%, more preferably less than about 0.5%, more preferably less than about 0.1%, and most preferably 0% by weight both TL1A and TNF-α binding competitors.

Purification

Methods of antibody purification are known in the art and can be employed with production of the antibodies and bispecific antibodies of the present invention. In some embodiments of the invention, methods for antibody purification include filtration, affinity column chromatography, cation exchange chromatography, anion exchange chromatography, and concentration. The filtration step preferably comprises ultrafiltration, and more preferably ultrafiltration and diafiltration. Filtration is preferably performed at least about 5-50 times, more preferably 10 to 30 times, and most preferably 14 to 27 times. Affinity column chromatography, may be performed using, for example, PROSEP® Affinity Chromatography (Millipore, Billerica, Mass.). In a preferred embodiment, the affinity chromatography step comprises PROSEP®-vA column chromatography. Eluate may be washed in a solvent detergent. Cation exchange chromatography may include, for example, SP-Sepharose Cation Exchange Chromatography. Anion exchange chromatography may include, for example but not limited to, Q-Sepharose Fast Flow Anion Exchange. The anion exchange step is preferably non-binding, thereby allowing removal of contaminants including DNA and BSA. The antibody product is preferably nanofiltered, for example, using a Pall DV 20 Nanofilter. The antibody product may be concentrated, for example, using ultrafiltration and diafiltration. The method may further comprise a step of size exclusion chromatography to remove aggregates. Further parameters of purification appear in the working examples hereinafter.

The bispecific antibodies, antibodies or antigen-binding fragments may also be produced by other methods known in the art, for example by chemical coupling of antibodies and antibody fragments.

Uses of the Monospecific and Bispecific Antibodies of the Invention

The bispecific antibodies and monospecific antibodies of the present invention are useful, for example, for the inhibition of proinflammatory cytokines, such as TL1A and TNF-α. The bispecific antibodies and monospecific antibodies of the invention can be used to treat inflammatory disorders and autoimmune diseases, such as inflammatory bowel disease (IBD), Crohn's disease (CD), ulcerative colitis (UC), irritable bowel syndrome (IBS), bladder syndrome/intersticial cystitis, urinary bowel disfunction, sepsis, uveitis, encephalomyelitis, myasthenia gravis, Sjogren's syndrome (SS), scleroderma, multiple sclerosis (MS), cystic fibrosis (CF), inflammation in chronic kidney disease (CKD), psoriasis (Pso), psoriatic arthritis (PsA), ankylosing spondylitis (AS), rheumatoid arthritis (RA), juvenile rheumatoid arthritis (JRA), osteoarthritis (OA), spondyloarthropathy, primary sclerosing cholangitis, primary biliary cirrhosis, atherosclerosis, splenomegaly, inflammation in chronic kidney disease (CKD), atopic dermatitis (AD), eczematous dermatitis, contact dermatitis systemic sclerosis, systemic lupus erythematosus (SLE), lupus nephritis (LN), cutaneous lupus erythematosus, autoimmune thyroiditis, IgA nephropathy, diabetic kidney disease, antineutrophil cytoplasmic antibodies (ANCA)-associated vasculitis (AAV), minimal change disease (lipoid nephrosis), focal segmental glomerulosclerosis (FSGS), nephrogenic systemic fibrosis (NSF), nephrogenic fibrosing dermopathy, fibrosing cholestatic hepatitis, eosinophilic fasciitis (Shulman's syndrome), scleromyxedema (popular mucinosis), scleroderma, lichen sclerosusetatrophicus, inflammatory lung injury such as idiopathic pulmonary fibrosis, asthma, chronic obstructive pulmonary disease (COPD), airway hyper-responsiveness, chronic bronchitis, allergic asthma, eczema, *Helicobacter pylori* infection, intraabdominal adhesions and/or abscesses as results of peritoneal inflammation (e.g., from infection, injury, etc.), nephrotic syndrome, idiopathic demyelinating polyneuropathy, Guillain-Barre syndrome, transplant rejection, organ allograft rejection, graft vs. host disease (GVHD) (e.g., from a transplant, such as blood, bone marrow, kidney, pancreas, liver, orthotopic liver, lung, heart, intestine, small intestine, large intestine, thymus, allogeneic stem cell, reduced-intensity allogeneic, bone, tendon, cornea, skin, heart valves, veins, arteries, blood vessels, stomach and testis), IgA nephropathy, diabetic kidney disease, diabetes mellitus, minimal change disease (lipoid nephrosis), nephrogenic systemic fibrosis (NSF), nephrogenic fibrosing dermopathy, fibrosing cholestatic hepatitis, eosinophilic fasciitis (Shulman's syndrome), scleromyxedema (popular mucinosis), scleroderma, lichen sclerosusetatrophicus, Takatsuki disease (or PEP syndrome), nephrotic syndrome, POEMs syndrome, Crow-Fukase syndrome, nephrotic syndrome, antineutrophil cytoplasmic antibodies, vasculitis, giant cell arteritis and multiple-myeloma-induced lytic bone disease, streptococcal cell wall (SCW)-induced arthritis, gingivitis/periodontitis, herpetic stromal keratitis, gluten-sensitive enteropathy restenosis, Kawasaki's disease, and immune-mediated renal diseases. The bispecific antibodies and monospecific antibodies described herein can also be used to treat cancer, including angiogenesis.

In one embodiment, the invention concerns methods of treating one or more of the aforementioned diseases and disorders in a mammal in need of such treatment by administering a therapeutically effective amount of a monospecific or bispecific antigen binding protein of the present invention. In a preferred embodiment the mammal is a human. In another preferred embodiment, the disease or disorder is IBD, CD, or UC.

The invention further concerns the use of the bispecific and monospecific antibodies of the present invention in the treatment of inflammatory diseases characterized by the presence of elevated levels of TL1A or/(in the case of the bispecific antibodies) TNF-α, and in the treatment of cancers characterized by the presence of elevated levels of TL1A and/or TNF-α.

Accordingly, in one embodiment, the present invention provides a method of inhibiting one or more of proinflammatory cytokines, e.g., TL1A and TNF-α, in a mammal in need of such treatment comprising administering a therapeutically effective amount of a bispecific or monospecific antibody of the invention to a mammal in need of such treatment. In a preferred embodiment, the mammal is a human. The method may be used to treat a disorder characterized by elevated expression or activity of TL1A or TNF-α. The monospecific or bispecific antigen binding protein may be administered with another pharmaceutical agent, either in the same formulation or separately.

In another embodiment, the present invention provides a composition comprising a monospecific or bispecific antigen binding protein as described herein and a pharmaceutically acceptable carrier. A pharmaceutical composition comprising an antibody, e.g., a bispecific antigen binding protein, of the invention can be formulated according to known methods to prepare pharmaceutically useful compositions, whereby the therapeutic antibodies are combined in a mixture with a pharmaceutically acceptable carrier. A composition is said to comprise a "pharmaceutically acceptable carrier" if its administration can be tolerated by a recipient patient. Sterile phosphate-buffered saline is one example of a pharmaceutically acceptable carrier. Other suitable carriers are well-known to those in the art. See, for example, Getman), ed., Remington's Pharmaceutical Sciences, 19th Edition, Mack Publishing Company (1995).

For pharmaceutical use, an antibody, e.g., a bispecific antigen binding protein, of the present invention is formulated for parenteral, particularly intravenous or subcutaneous, delivery according to conventional methods. Intravenous administration may be by bolus injection, controlled release, e.g., using mini-pumps or other appropriate technology, or by infusion over a typical period of one to several hours. In general, pharmaceutical formulations will include an antibody, e.g., a bispecific antigen binding protein, of the invention in combination with a pharmaceutically acceptable carrier, such as saline, buffered saline, 5% dextrose in water or the like. Formulations may further include one or more excipients, preservatives, solubilizers, buffering agents, albumin to prevent protein loss on vial surfaces, etc. When utilizing such a combination therapy, the antibodies, which include bispecific antibodies, may be combined in a single formulation or may be administered in separate formulations. Methods of formulation are well known in the art and are disclosed, for example, in Gennaro, ed., Remington's Pharmaceutical Sciences, Mack Publishing Co., Easton Pa. (1990), which is incorporated herein by reference. Therapeutic doses will generally be in the range of 0.1 to 100 mg/kg of patient weight per day, preferably 0.5-20 mg/kg per day, with the exact dose determined by the clinician according to accepted standards, taking into account the nature and severity of the condition to be treated, patient traits, etc. Determination of dose is within the level of ordinary skill in the art. More commonly, the antibodies will be administered over one week or less, often over a period of one to three days. Generally, the dosage of administered antibodies will vary depending upon such factors as the patient's age, weight, height, sex, general medical condition and previous medical history. Typically, it is desirable to provide the recipient with a dosage of antibodies which is in the range of from about 1 pg/kg to 10 mg/kg (amount of agent/body weight of patient), although a lower or higher dosage also may be administered as circumstances dictate.

Administration of an antibody, e.g., bispecific antigen binding protein, of the invention to a subject can be intravenous, intraarterial, intraperitoneal, intramuscular, subcutaneous, intrapleural, intrathecal, by perfusion through a regional catheter, or by direct intralesional injection. When administering therapeutic antibodies by injection, the administration may be by continuous infusion or by single or multiple boluses.

Additional routes of administration include oral, mucosal-membrane, pulmonary, and transcutaneous. Oral delivery is suitable for polyester microspheres, zein microspheres, proteinoid microspheres, polycyanoacrylate microspheres, and lipid-based systems (see, for example, DiBase et al., "Oral Delivery of Microencapsulated Proteins", in Sanders et al., eds., Protein Delivery: Physical Systems, pp. 255-288, Plenum Press (1997)). The feasibility of an intranasal delivery is exemplified by such a mode of insulin administration (see, for example, Hinchcliffe et al., Adv. Drug Deliv. Rev., 35:199 (1999)). Dry or liquid particles comprising antibodies of the invention can be prepared and inhaled with the aid of dry-powder dispersers, liquid aerosol generators, or nebulizers (e.g., Pettit et al., TIBTECH, 16:343 (1998); Patton et al., Adv. Drug Deliv. Rev., 35:235 (1999)). This approach is illustrated by the AERX® diabetes management system, which is a hand-held electronic inhaler that delivers aerosolized insulin into the lungs. Studies have shown that proteins as large as 48,000 kDa have been delivered across skin at therapeutic concentrations with the aid of low-frequency ultrasound, which illustrates the feasibility of transcutaneous administration (Mitragotri et al., Science, 269:850 (1995)). Transdermal delivery using electroporation provides another means to administer a molecule having IL-17 and TNF-α/p19 binding activity (Potts et al., Pharm. Biotechnol., 10:213 (1997)).

For purposes of therapy, compositions comprising an antibody, e.g., a bispecific antigen binding protein, of the invention and a pharmaceutically acceptable carrier are administered to a patient in a therapeutically effective amount. A combination of an antibody, e.g., a bispecific antigen binding protein, of the present invention and a pharmaceutically acceptable carrier is said to be administered in a "therapeutically effective amount" if the amount administered is physiologically significant. An agent is physiologically significant if its presence results in a detectable change in the physiology of a recipient patient. For example, an agent used to treat inflammation is physiologically significant if its presence alleviates the inflammatory response. Effective treatment may be assessed in a variety of ways. In one embodiment, effective treatment is determined by reduced inflammation. In other embodiments, effective treatment is marked by inhibition of inflammation. In still other embodiments, effective therapy is measured by increased well-being of the patient including such signs as weight gain, regained strength, decreased pain, thriving, and subjective indications from the patient of better health.

A pharmaceutical composition comprising an antibody, e.g., a bispecific antigen binding protein, of the invention can be furnished in liquid form, in an aerosol, or in solid form. Liquid forms, are illustrated by injectable solutions and oral suspensions. Exemplary solid forms include capsules, tablets, and controlled-release forms. The latter form is illustrated by miniosmotic pumps and implants (Bremer et al., Pharm. Biotechnol., 10:239 (1997); Ranade, "Implants in Drug Delivery", in Ranade et al., eds., Drug Delivery Systems, pp. 95-123, CRC Press (1995); Bremer et al., "Protein Delivery with Infusion Pumps", in Sanders et al., eds., Protein Delivery: Physical Systems, pp. 239-254, Plenum Press (1997); Yewey et al., "Delivery of Proteins from a Controlled Release Injectable Implant", in Sanders et al., eds., Protein Delivery: Physical Systems, pp. 93-117, Plenum Press (1997).

Liposomes provide one means to deliver therapeutic polypeptides to a subject intravenously, intraperitoneally, intrathecally, intramuscularly, subcutaneously, or via oral administration, inhalation, or intranasal administration. Liposomes are microscopic vesicles that consist of one or more lipid bilayers surrounding aqueous compartments (see, generally, Bakker-Woudenberg et al., Eur. J. Clin. Microbiol. Infect. Dis., 12(Suppl. 1):561 (1993), Kim, Drugs, 46:618 (1993), and Ranade, "Site-Specific Drug Delivery Using Liposomes as Carriers", in Ranade et al., eds., Drug Delivery Systems, pp. 3-24, CRC Press (1995)). Liposomes are similar in composition to cellular membranes and as a result, liposomes can be administered safely and are biodegradable. Depending on the method of preparation, liposomes may be unilamellar or multilamellar, and liposomes can vary in size with diameters ranging from 0.02. mu.m to greater than 10. mu.m. A variety of agents can be encapsulated in liposomes: hydrophobic agents partition in the bilayers and hydrophilic agents partition within the inner aqueous space(s) (see, for example, Machy et al., Liposomes in Cell Biology and Pharmacology, John Libbey (1987), and Ostro et al., American J. Hosp. Pharm., 46:1576 (1989)). Moreover, it is possible to control the therapeutic availability of the encapsulated agent by varying liposome size, the number of bilayers, lipid composition, as well as the charge and surface characteristics of the liposomes.

Liposomes can absorb to virtually any type of cell and then slowly release the encapsulated agent. Alternatively, an absorbed liposome may be endocytosed by cells that are phagocytic. Endocytosis is followed by intralysosomal degradation of liposomal lipids and release of the encapsulated agents (Scherphof et al., Ann. N.Y. Acad. Sci., 446:368 (1985)). After intravenous administration, small liposomes (0.1 to 1.0. mu.m) are typically taken up by cells of the reticuloendothelial system, located principally in the liver and spleen, whereas liposomes larger than 3.0. mu.m are deposited in the lung. This preferential uptake of smaller liposomes by the cells of the reticuloendothelial system has been used to deliver chemotherapeutic agents to macrophages and to tumors of the liver.

The reticuloendothelial system can be circumvented by several methods including saturation with large doses of liposome particles, or selective macrophage inactivation by pharmacological means (Claassen et al., *Biochim. Biophys. Acta,* 802:428 (1984)). In addition, incorporation of glycolipid- or polyethelene glycol-derivatized phospholipids into liposome membranes has been shown to result in a significantly reduced uptake by the reticuloendothelial system (Allen et al., *Biochim. Biophys. Acta,* 1068:133 (1991); Allen et al., *Biochim. Biophys. Acta,* 1150:9 (1993)).

Liposomes can also be prepared to target particular cells or organs by varying phospholipid composition or by inserting receptors or ligands into the liposomes. For example, liposomes, prepared with a high content of a nonionic surfactant, have been used to target the liver (Hayakawa et al., Japanese Patent No. 04-244,018; Kato et al., Biol. Pharm. Bull., 16:960 (1993)). These formulations were prepared by mixing soybean phosphatidylcholine, .alpha.-tocopherol, and ethoxylated hydrogenated castor oil (HCO-60) in methanol, concentrating the mixture under vacuum, and then reconstituting the mixture with water. A liposomal formulation of dipalmitoylphosphatidylcholine (DPPC) with a soybean-derived sterylglucoside mixture (SG) and cholesterol (Ch) has also been shown to target the liver (Shimizu et al., Biol. Pharm. Bull., 20:881 (1997)).

Alternatively, various targeting ligands can be bound to the surface of the liposome, such as antibodies, antibody fragments, carbohydrates, vitamins, and transport proteins. For example, liposomes can be modified with branched type galactosyllipid derivatives to target asialoglycoprotein (galactose) receptors, which are exclusively expressed on the surface of liver cells (Kato et al., *Crit. Rev. Ther. Drug Carrier Syst.,* 14:287 (1997); Murahashi et al., *Biol. Pharm. Bull.,* 20:259 (1997)). Similarly, Wu et al., *Hepatology,* 27:772 (1998), have shown that labeling liposomes with asialofetuin led to a shortened liposome plasma half-life and greatly enhanced uptake of asialofetuin-labeled liposome by hepatocytes. On the other hand, hepatic accumulation of liposomes comprising branched type galactosyllipid derivatives can be inhibited by preinjection of asialofetuin (Murahashi et al., *Biol. Pharm. Bull.,* 20:259 (1997)). Polyaconitylated human serum albumin liposomes provide another approach for targeting liposomes to liver cells (Kamps et al., *Proc. Nat'l Acad. Sci. USA,* 94:11681 (1997)). Moreover, Geho et al. U.S. Pat. No. 4,603,044, describe a hepatocyte-directed liposome vesicle delivery system, which has specificity for hepatobiliary receptors associated with the specialized metabolic cells of the liver.

In a more general approach to tissue targeting, target cells are prelabeled with biotinylated antibodies specific for a ligand expressed by the target cell (Harasym et al., *Adv. Drug Deliv. Rev.*, 32: 99 (1998)). After plasma elimination of free antibody, streptavidin-conjugated liposomes are administered. In another approach, targeting antibodies are directly attached to liposomes (Harasym et al., *Adv. Drug Deliv. Rev.*, 32: 99 (1998)).

Antibodies can be encapsulated within liposomes using standard techniques of protein microencapsulation (see, for example, Anderson et al., *Infect. Immun.*, 31:1099 (1981), Anderson et al., *Cancer Res.*, 50:1853 (1990), and Cohen et al., *Biochim. Biophys. Acta*, 1063:95 (1991), Alving et al. "Preparation and Use of Liposomes in Immunological Studies", in Gregoriadis, ed., *Liposome Technology*, 2nd Edition, Vol. III, p. 317, CRC Press (1993), Wassef et al., *Meth. Enzymol.*, 149:124 (1987)). As noted above, therapeutically useful liposomes may contain a variety of components. For example, liposomes may comprise lipid derivatives of poly (ethylene glycol) (Allen et al., *Biochim. Biophys. Acta*, 1150:9 (1993)).

Degradable polymer microspheres have been designed to maintain high systemic levels of therapeutic proteins. Microspheres are prepared from degradable polymers such as poly(lactide-co-glycolide) (PLG), polyanhydrides, poly (ortho esters), nonbiodegradable ethylvinyl acetate polymers, in which proteins are entrapped in the polymer (Gombotz et al., *Bioconjugate Chem.*, 6:332 (1995); Ranade, "Role of Polymers in Drug Delivery", in Ranade et al., eds., *Drug Delivery Systems*, pp. 51-93, CRC Press (1995); Roskos et al., "Degradable Controlled Release Systems Useful for Protein Delivery", in Sanders et al., eds., *Protein Delivery: Physical Systems*, pp. 45-92, Plenum Press (1997); Bartus et al., *Science*, 281:1161 (1998); Putney et al., *Nature Biotechnology*, 16:153 (1998); Putney, *Curr. Opin. Chem. Biol.*, 2:548 (1998)). Polyethylene glycol (PEG)-coated nanospheres can also provide carriers for intravenous administration of therapeutic proteins (see, for example, Gref et al., *Pharm. Biotechnol.*, 10:167 (1996).

The formulation can also contain more than one active compound as necessary for the particular indication being treated, preferably those with complementary activities that do not adversely affect each other. Alternatively, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

In one embodiment, an antibody, e.g., a bispecific antigen binding protein, of the invention is administered in combination therapy, i.e., combined with other agents, e.g., therapeutic agents, that are useful for treating pathological conditions or disorders, such as autoimmune disorders and inflammatory diseases. The term "in combination" in this context means that the agents are given substantially contemporaneously, either simultaneously or sequentially. If given sequentially, at the onset of administration of the second compound, the first of the two compounds is preferably still detectable at effective concentrations at the site of treatment.

For example, the combination therapy can include one or more an antibodies, e.g., bispecific antibodies, of the invention coformulated with, and/or coadministered with, one or more additional therapeutic agents, e.g., one or more cytokine and growth factor inhibitors, immunosuppressants, anti-inflammatory agents, metabolic inhibitors, enzyme inhibitors, and/or cytotoxic or cytostatic agents, as described in more detail below. Furthermore, one or more antibodies, e.g., bispecific antibodies, described herein may be used in combination with two or more of the therapeutic agents described herein. Such combination therapies may advantageously utilize lower dosages of the administered therapeutic agents, thus avoiding possible toxicities or complications associated with the various monotherapies.

Preferred therapeutic agents used in combination with an antibody, e.g., bispecific antigen binding protein, of the invention are those agents that interfere at different stages in an inflammatory response. In one embodiment, one or more antibodies, e.g., bispecific antibodies, described herein may be co-formulated with, and/or co-administered with, one or more additional agents such as other cytokine or growth factor antagonists (e.g., soluble receptors, peptide inhibitors, small molecules, ligand fusions); or antibodies or antigen binding fragments thereof that bind to other targets (e.g., antibodies that bind to other cytokines or growth factors, their receptors, or other cell surface molecules); and anti-inflammatory cytokines or agonists thereof. Non-limiting examples of the agents that can be used in combination with the antibodies described herein, include, but are not limited to, antagonists of one or more interleukins (ILs) or their receptors, e.g., antagonists of IL-1, IL-2, IL-6, IL-7, IL-8, IL-12, IL-13, IL-15, IL-16, IL17A-F, IL-18, IL-20, IL-21, IL-22, IL-25 and IL-31; antagonists of cytokines or growth factors or their receptors, such as, LT, EMAP-II, GM-CSF, FGF and PDGF. Antibodies of the invention can also be combined with inhibitors of e.g., antibodies to, cell surface molecules such as CD2, CD3, CD4, CD8, CD20 (e.g., the CD20 inhibitor rituximab (RITUXAN®), CD25, CD28, CD30, CD40, CD45, CD69, CD80 (B7.1), CD86 (B7.2), CD90, or their ligands, including CD154 (gp39 or CD40L), or LFA-1/ICAM-1 and VLA-4/VCAM-1 (Yusuf-Makagiansar et al., *Med. Res. Rev.*, 22:146-167 (2002)). Preferred antagonists that can be used in combination with one or more antibodies, e.g., bispecific antibodies, described herein include antagonists of IL-1, IL-6, IL-12, TNF-α, IL-15, IL-18, IL-20, IL-22 and IL-31.

Examples of those agents include IL-12 antagonists, such as chimeric, humanized, human or in vitro-generated antibodies (or antigen binding fragments thereof) that bind to IL-12 (preferably human IL-12), e.g., the antibody disclosed in WO 00/56772; IL-12 receptor inhibitors, e.g., antibodies to human IL-12 receptor; and soluble fragments of the IL-12 receptor, e.g., human IL-12 receptor. Examples of IL-15 antagonists include antibodies (or antigen binding fragments thereof) against IL-15 or its receptor, e.g., chimeric, humanized, human or in vitro-generated antibodies to human IL-15 or its receptor, soluble fragments of the IL-15 receptor, and IL-15-binding proteins. Examples of IL-17 antagonists include brodalumab, secukinumab, and ixekizumab. Examples of IL-18 antagonists include antibodies, e.g., chimeric, humanized, human or in vitro-generated antibodies (or antigen binding fragments thereof), to human IL-18, soluble fragments of the IL-18 receptor, and IL-18 binding proteins (IL-18BP). Examples of IL-1 antagonists include Interleukin-1-converting enzyme (ICE) inhibitors, such as Vx740, IL-1 antagonists, e.g., IL-1 RA (anakinra, Kineret®) sIL1RII, and anti-IL-1 receptor antibodies (or antigen binding fragments thereof).

In other embodiments, one or more antibodies, e.g., bispecific antibodies, described herein may be administered in combination with one or more of the following: IL-13 antagonists, e.g., soluble IL-13 receptors (sIL-13) and/or antibodies against IL-13; IL-2 antagonists, e.g., DAB 486-IL-2 and/or DAB 389-IL-2 (IL-2 fusion proteins, Seragen), and/or antibodies to IL-2R, e.g., anti-Tac (humanized anti-IL-2R, Protein Design Labs). Yet another combination includes one or more antibodies, e.g., bispecific antibodies, of the invention, antagonistic small molecules, and/or inhibitory antibodies in combination with nondepleting anti-CD4 inhibitors (DEC-CE9.1/SB 210396; non-depleting primatized anti-CD4 antibody; IDEC/SmithKline). Yet other preferred combinations include antagonists of the costimulatory pathway CD80 (B7.1) or CD86 (B7.2), including antibodies, soluble receptors or antagonistic ligands; as well as p-selectin glycoprotein ligand (PSGL), anti-inflammatory cytokines, e.g., IL-4 (DNAX/Schering); IL-10 (SCH 52000; recombinant IL-10 DNAX/Schering); IL-13 and TGF-beta, and agonists thereof (e.g., agonist antibodies).

In other embodiments, one or more antibodies, e.g., bispecific antibodies, of the invention can be co-formulated with, and/or co-administered with, one or more anti-inflammatory drugs, immunosuppressants, or metabolic or enzymatic inhibitors. Non-limiting examples of the drugs or inhibitors that can be used in combination with the antibodies described herein, include, but are not limited to, one or more of: nonsteroidal anti-inflammatory drug(s) (NSAIDs), e.g., ibuprofen, tenidap, naproxen, meloxicam, piroxicam, diclofenac, and indomethacin; sulfasalazine; corticosteroids such. as prednisolone; cytokine suppressive anti-inflammatory drug(s) (CSAIDs); inhibitors of nucleotide biosynthesis, e.g., inhibitors of purine biosynthesis, folate antagonists (e.g., methotrexate (N-[4-[[(2,4-diamino-6-pteridinyl) methyl]methylamino]benzoyl]-glutamic acid); and inhibitors of pyrimidine biosynthesis, e.g., dihydroorotate dehydrogenase (DHODH) inhibitors. Preferred therapeutic agents for use in combination with one or more antibodies, e.g., bispecific antibodies, of the invention include NSAIDs, CSAIDs, (DHODH) inhibitors (e.g., leflunomide), and folate antagonists (e.g., methotrexate).

Examples of additional inhibitors include one or more of: corticosteroids (oral, inhaled and local injection); immunosuppressants, e.g., cyclosporin, tacrolimus (FK-506); and mTOR inhibitors, e.g., sirolimus (rapamycin—RAPAMUNE® or rapamycin derivatives, e.g., soluble rapamycin derivatives (e.g., ester rapamycin derivatives, e.g., CCI-779); agents which interfere with signaling by proinflammatory cytokines such as IL-1 (e.g., IRAK, NIK, IKK, p38 or MAP kinase inhibitors); COX2 inhibitors, e.g., celecoxib, rofecoxib, and variants thereof; phosphodiesterase inhibitors, e.g., R973401 (phosphodiesterase Type IV inhibitor); phospholipase inhibitors, e.g., inhibitors of cytosolic phospholipase 2 (cPLA2) (e.g., trifluoromethyl ketone analogs); inhibitors of vascular endothelial cell growth factor or growth factor receptor, e.g., VEGF inhibitor and/or VEGF-R inhibitor; and inhibitors of angiogenesis. Preferred therapeutic agents for use in combination with the antibodies of the invention are immunosuppressants, e.g., cyclosporin, tacrolimus (FK-506); mTOR inhibitors, e.g., sirolimus (rapamycin) or rapamycin derivatives, e.g., soluble rapamycin derivatives (e.g., ester rapamycin derivatives, e.g., CCI-779); COX2 inhibitors, e.g., celecoxib and variants thereof; and phospholipase inhibitors, e.g., inhibitors of cytosolic phospholipase 2 (cPLA2), e.g., trifluoromethyl ketone analogs.

Additional examples of therapeutic agents that can be combined with an antibody, e.g., bispecific antigen binding protein, of the invention include one or more of: 6-mercaptopurines (6-MP); azathioprine sulphasalazine; mesalazine; olsalazine; chloroquine/hydroxychloroquine (PLAQUENIL®); pencillamine; aurothiornalate (intramuscular and oral); azathioprine; coichicine; beta-2 adrenoreceptor agonists (salbutamol, terbutaline, salmeteral); xanthines (theophylline, aminophylline); cromoglycate; nedocromil; ketotifen; ipratropium and oxitropium; mycophenolate mofetil; adenosine agonists; antithrombotic agents; complement inhibitors; and adrenergic agents.

Anti-TL1A antibodies of the invention may be combined with TNF-α antagonists for treatment of the same conditions as noted herein for anti-TL1A/anti-TNF-α bispecific antigen binding proteins. Such TNF-α antagonists include, for example, etanercept, adalimumab, infliximab, golimumab, and certolizumab pegol.

Non-limiting examples of agents for treating or preventing arthritic disorders (e.g., rheumatoid arthritis, inflammatory arthritis, rheumatoid arthritis, juvenile rheumatoid arthritis, osteoarthritis and psoriatic arthritis), with which an antibody, e.g., bispecific antigen binding protein, of the invention may be combined include one or more of the following: IL-12 antagonists as described herein; NSAIDs; CSAIDs; nondepleting anti-CD4 antibodies as described herein; IL-2 antagonists as described herein; anti-inflammatory cytokines, e.g., IL-4, IL-10, IL-13 and TGF-α, or agonists thereof; IL-1 or IL-1 receptor antagonists as described herein; phosphodiesterase inhibitors as described herein; Cox-2 inhibitors as described herein; iloprost: methotrexate; thalidomide and thalidomide-related drugs (e.g., Celgen); leflunomide; inhibitor of plasminogen activation, e.g., tranexamic acid; cytokine inhibitor, e.g., T-614; prostaglandin E1; azathioprine; an inhibitor of interleukin-1 converting enzyme (ICE); zap-70 and/or 1 ck inhibitor (inhibitor of the tyrosine kinase zap-70 or 1 ck); an inhibitor of vascular endothelial cell growth factor or vascular endothelial cell growth factor receptor as described herein; an inhibitor of angiogenesis as described herein; corticosteroid anti-inflammatory drugs (e.g., SB203580); TNF-α-convertase inhibitors; IL-1; IL-13; IL-17 inhibitors; gold; penicillamine; chloroquine; hydroxychloroquine; chlorambucil; cyclophosphamide; cyclosporine; total lymphoid irradiation; antithymocyte globulin; CD5-toxins; orally administered peptides and collagen; lobenzarit disodium; cytokine regulating agents (CRAs) HP228 and HP466 (Houghten Pharmaceuticals, Inc.); ICAM-1 antisense phosphorothioate oligodeoxynucleotides (ISIS 2302; Isis Pharmaceuticals, Inc.); soluble complement receptor 1 (TP 10; T Cell Sciences, Inc.); prednisone; orgotein; glycosaminoglycan polysulphate; minocycline (MINOCIN®); anti-IL2R antibodies; marine and botanical lipids (fish and plant seed fatty acids); auranofin; phenylbutazone; meclofenamic acid; flufenamic acid; intravenous immune globulin; zileuton; mycophenolic acid (RS-61443); tacrolimus (FK-506); sirolimus (rapamycin); amiprilose (therafectin); cladribine (2-chlorodeoxyadenosine); and azaribine. Preferred combinations include one or more antibodies, e.g., bispecific antibodies, of the invention in combination with methotrexate or leflunomide, and in moderate or severe rheumatoid arthritis cases, cyclosporine.

Preferred examples of inhibitors to use in combination with one or more antigen binding proteins, e.g., bispecific antigen binding proteins, of the invention to treat arthritic disorders include antagonists of IL-12, IL-15, IL-18, IL-22; T cell and B cell-depleting agents (e.g., anti-CD4 or anti-CD22 antibodies); small molecule inhibitors, e.g., methotrexate and leflunomide; sirolimus (rapamycin) and analogs thereof, e.g., CCI-779; cox-2 and cPLA2 inhibitors; NSAIDs; p38 inhibitors, TPL-2, Mk-2 and NFκB inhibitors; RAGE or soluble RAGE; P-selectin or PSGL-1 inhibitors (e.g., small molecule inhibitors, antibodies to PSGL-1, antibodies to P-selectin); estrogen receptor beta (ERB) agonists or ERB-NFκB antagonists. Most preferred additional therapeutic agents that can be co-administered and/or co-formulated with one or more antibodies, e.g., bispecific antibodies, of the invention include one or more of: methotrexate, leflunomide, or a sirolimus (rapamycin) or an analog thereof, e.g., CCI-779.

Non-limiting examples of agents for treating or preventing an inflammatory disease or disorder, (e.g., IBD, CD, UC, IBS) with which an antibody, e.g., bispecific antigen binding protein, of the invention can be combined include the following: budenoside; epidermal growth factor; corticosteroids; cyclosporine; sulfasalazine; aminosalicylates; 6-mercaptopurine; azathioprine; metronidazole; lipoxygenase inhibitors; mesalamine; olsalazine; balsalazide; antioxidants; thromboxane inhibitors; IL-1 receptor antagonists; anti-IL-1 monoclonal antibodies; anti-IL-6 monoclonal antibodies (e.g., anti-IL-6 receptor antibodies and anti-IL-6 antibodies); growth factors; elastase inhibitors; pyridinyl-imidazole compounds; IL-4, IL-10, IL-13 and/or TGF.beta. cytokines or agonists thereof (e.g., agonist antibodies); IL-11; glucuronide- or dextran-conjugated prodrugs of prednisolone, dexamethasone or budesonide; ICAM-1 antisense phosphorothioate oligodeoxynucleotides (ISIS 2302; Isis Pharmaceuticals, Inc.); soluble complement receptor 1 (TP10; T Cell Sciences, Inc.); slow-release mesalazine; methotrexate; antagonists of platelet activating factor (PAF); ciprofloxacin; and lignocaine.

Non-limiting examples of agents for treating or preventing multiple sclerosis with one or more antibodies, e.g., bispecific antibodies, of the invention can be combined include the following: interferons, e.g., interferon-α (e.g., AVONEX®, Biogen) and interferon-1b (BETASERON®, Chiron/Berlex); Copolymer 1 (Cop-1; COPAXONE®, Teva Pharmaceutical Industries, Inc.); dimethyl fumarate (e.g., BG-12; Biogen); hyperbaric oxygen; intravenous immunoglobulin; cladribine; corticosteroids; prednisolone; methylprednisolone; azathioprine; cyclophosphamide; cyclosporine; cyclosporine A, methotrexate; 4-aminopyridine; and tizanidine. Additional antagonists that can be used in combination with antibodies of the invention include antibodies to or antagonists of other human cytokines or growth factors, for example, LT, IL-1, IL-2, IL-6, EL-7, IL-8, IL-12 IL-15, IL-16, IL-18, EMAP-11, GM-CSF, FGF, and PDGF. Antibodies as described herein can be combined with antibodies to cell surface molecules such as CD2, CD3, CD4, CD8, CD25, CD28, CD30, CD40, CD45, CD69, CD80, CD86, CD90 or their ligands. One or more antibodies, e.g., bispecific antibodies, of the invention may also be combined with agents, such as methotrexate, cyclosporine, FK506, rapamycin, mycophenolate mofetil, leflunomide, NSAIDs, for example, ibuprofen, corticosteroids such as prednisolone, phosphodiesterase inhibitors, adenosine agonists, antithrombotic agents, complement inhibitors, adrenergic agents, agents which interfere with signaling by proinflammatory cytokines as described herein, IL-1b converting enzyme inhibitors (e.g., Vx740), anti-P7s, PSGL, TACE inhibitors, T-cell signaling inhibitors such as kinase inhibitors, metalloproteinase inhibitors, sulfasalazine, azathioprine, 6-mercaptopurines, angiotensin converting enzyme inhibitors, soluble cytokine receptors and derivatives thereof, as described herein, and anti-inflammatory cytokines (e.g., IL-4, IL-10, IL-13 and TGF).

Preferred examples of therapeutic agents for multiple sclerosis with which the antibodies of the invention can be combined include dimethyl fumarate (e.g., BG-12; Biogen), interferon-beta, for example, IFN-β-1a and IFN-β-1b; COPAXONE®, corticosteroids, IL-1 inhibitors, antibodies to CD40 ligand and CD80, IL-12 antagonists.

Non-limiting examples of agents for treating or preventing psoriasis with which an antibody, e.g., bispecific antigen binding protein, of the invention can be combined include the following: corticosteroids; vitamin. D3 and analogs thereof; retinoiods (e.g., soriatane); methotrexate; cyclosporine, 6-thioguanine; Accutane; hydrea; hydroxyurea; sulfasalazine; mycophenolate mofetil; azathioprine; tacrolimus; fumaric acid esters; biologics such as AMEVIVE®, Raptiva ustekinumab, and XP-828L; phototherapy; and photochemotherapy (e.g., psoralen and ultraviolet phototherapy combined).

Non-limiting examples of agents for treating or preventing inflammatory airway/respiratory disease (e.g., chronic obstructive pulmonary disorder, asthma) with which an antibody, e.g., bispecific antigen binding protein, of the invention can be combined include the following: beta2-adrenoceptor agonists (e.g., salbutamol (albuterol), levalbuterol, terbutaline, bitolterol); long-acting beta2-adrenoceptor agonists (e.g., salmeterol, formoterol, bambuterol); adrenergic agonists (e.g., inhaled epinephrine and ephedrine tablets); anticholinergic medications (e.g., ipratropium bromide); combinations of inhaled steroids and long-acting bronchodilators (e.g., fluticasone/salmeterol (ADVAIR® in the United States, and Seretide in the United Kingdom)) or. budesonide/formoterol (SYMBICORT®)); inhaled glucocorticoids (e.g., ciclesonide, beclomethasone, budesonide, flunisolide, fluticasone, mometasone, triamcinolone); leukotriene modifiers (e.g., montelukast, zafirlukast, pranlukast, and zileuton); mast cell stabilizers (e.g., cromoglicate (cromolyn), and nedocromil); antimuscarinics/anticholinergics (e.g., ipratropium, oxitropium, tiotropium); methylxanthines (e.g., theophylline, aminophylline); antihistamines; IgE blockers (e.g., omalizumab); $M_3$ muscarinic antagonists (anticholinergics) (e.g., ipratropium, tiotropium); cromones (e.g., chromoglicate, nedocromil); zanthines (e.g., theophylline); IL-17 inhibitors (e.g., brodalumab, secukinumab, ixekizumab), IL-4 inhibitors; and IL-13 inhibitors.

In one embodiment, an antibody, e.g., bispecific antigen binding protein, of the invention can be used in combination with one or more antibodies directed at other targets involved in regulating immune responses, e.g., transplant rejection.

Non-limiting examples of agents for treating or preventing immune responses with which an antibody, e.g., bispecific antigen binding protein, of the invention can be combined include the following: antibodies against other cell surface molecules, including but not limited to CD25 (interleukin-2 receptor-α), CD11a (LFA-1), CD54 (ICAM-1), CD4, CD45, CD28/CTLA4 (CD80 (B7.1), e.g., CTLA4 Ig (abatacept, ORENCIA®), ICOSL, ICOS and/or CD86 (B7.2). In yet another embodiment, an antibody of the invention is used in combination with one or more general immunosuppressive agents, such as cyclosporin A or FK506.

In other embodiments, antibodies are used as vaccine adjuvants against autoimmune disorders, inflammatory diseases, etc. The combination of adjuvants for treatment of these types of disorders are suitable for use in combination with a wide variety of antigens from targeted self-antigens, i.e., autoantigens, involved in autoimmunity, e.g., myelin basic protein; inflammatory self-antigens (e.g., amyloid peptide protein) or transplant antigens (e.g., alloantigens). The antigen may comprise peptides or polypeptides derived from proteins, as well as fragments of any of the following: saccharides, proteins, polynucleotides or oligonucleotides, autoantigens, amyloid peptide protein, transplant antigens, allergens, or other macromolecular components. In some instances, more than one antigen is included in the antigenic composition.

For example, desirable vaccines for moderating responses to allergens in a vertebrate host, which contain the adjuvant combinations of this invention, include those containing an allergen or fragment thereof. Examples of such allergens are described in U.S. Pat. No. 5,830,877 and PCT Publication No. WO 99/51259, which are hereby incorporated by reference in their entireties, and include pollen, insect venoms, animal dander, fungal spores and drugs (such as penicillin). The vaccines interfere with the production of IgE antibodies, a known cause of allergic reactions. In another example, desirable vaccines for preventing or treating disease characterized by amyloid deposition in a vertebrate host, which contain the adjuvant combinations of this invention, include those containing portions of amyloid peptide protein (APP). This disease is referred to variously as Alzheimer's disease, amyloidosis or amyloidogenic disease. Thus, the vaccines of this invention include the adjuvant combinations of this invention plus A.beta. peptide, as well as fragments of Aβ peptide and antibodies to Aβ peptide or fragments thereof.

In another embodiment, pharmaceutical compositions may be supplied as a kit comprising a container that comprises an antibody, bispecific antigen binding protein or antigen-binding fragment of the invention. Antibodies, e.g., bispecific antibodies, of the invention can be provided in the form of an injectable solution for single or multiple doses, or as a sterile powder that will be reconstituted before injection. Alternatively, such a kit can include a dry-powder disperser, liquid aerosol generator, or nebulizer for administration of the antigen binding protein (e.g., anti-TL1A/anti-TNF-α bispecific antigen binding protein). Such a kit may further comprise written information on indications and usage of the pharmaceutical composition. Moreover, such information may include a statement that the antibody composition is contraindicated in patients with known hypersensitivity to TL1A and TNF-α.

In a further embodiment, the invention provides an article of manufacture, comprising: (a) a composition of matter comprising an antibody, bispecific antigen binding protein or antigen-binding fragment as described herein; (b) a container containing said composition; and (c) a label affixed to said container, or a package insert included in said container referring to the use of said antibody in the treatment of an immune related disease.

In another aspect, the composition comprises a further active ingredient, which may, for example, be a further antibody or an anti-inflammatory, cytotoxic or chemotherapeutic agent. Preferably, the composition is sterile.

The antibodies, e.g., bispecific antibodies, as described herein are also useful to prepare medicines and medicaments for the treatment of immune-related and inflammatory diseases, including for example, IBS, IBD, CD, UC. In a specific aspect, such medicines and medicaments comprise a therapeutically effective amount of a bispecific antigen binding protein, antibody or antigen-binding fragment of the invention with a pharmaceutically acceptable carrier. In an embodiment, the admixture is sterile.

The bispecific antigen binding proteins of the invention are useful for detecting TL1A and/or TNF-α in biological samples and identification of cells or tissues that express the TL1A receptor DR3 and/or TNF-α receptor. For instance, the bispecific antigen binding proteins can be used in diagnostic assays, e.g., binding assays to detect and/or quantify TL1A and/or TNF-α binding and/or expression in a tissue or cell. In addition, the bispecific antigen binding proteins described herein can be used to inhibit TL1A from forming a complex with its receptor DR3, thereby modulating the biological activity of TL1A or DR3 in a cell or tissue. Likewise, the bispecific antigen binding proteins described herein can be used to inhibit TNF-α from forming a complex with its receptor, thereby modulating the biological activity of TNF-α or its receptor in a cell or tissue. Exemplary activity that can be modulated includes, but is not limited to, inhibiting and/or reducing inflammation.

The bispecific antigen binding proteins described herein can be used for diagnostic purposes to detect, diagnose, or monitor diseases and/or conditions associated with TL1A and/or TNF-α. Also provided are methods for the detection of the presence of TL1A and/or TNF-α in a sample using classical immunohistological methods known to those of skill in the art. See, for example, Tijssen (1993), *Practice and Theory of Enzyme Immunoassays*, Vol 15 (Eds R. H. Burdon and P. H. van Knippenberg, Elsevier, Amsterdam); Zola (1987), *Monoclonal Antibodies: A Manual of Techniques*, pp. 147-158 (CRC Press, Inc.); Jalkanen et al. (1985), *J. Cell. Biol.* 101:976-985; Jalkanen et al. (1987), *J. Cell Biol.* 105:3087-3096. The detection of either TL1A and/or TNF-α can be performed in vivo or in vitro.

Diagnostic applications provided herein include use of the antigen binding proteins to detect expression of TL1A and/or TNF-α and binding of these ligands to their receptors. Examples of methods useful in the detection of the presence of the ligand include immunoassays, such as the enzyme linked immunosorbent assay (ELISA) and the radioimmunoassay (RIA).

For diagnostic applications, the antigen binding protein typically will be labeled with a detectable labeling group. Suitable labeling groups include, but are not limited to, the following: radioisotopes or radionuclides (e.g., $^3$H, $^{14}$C, $^{15}$N, $^{35}$S, $^{90}$Y, $^{99}$Tc, $^{111}$In, $^{125}$I, $^{131}$I), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labeling group is coupled to the antigen binding protein via spacer arms of various lengths to reduce potential steric hindrance. Various methods for labeling proteins are known in the art and may be used.

In another embodiment, the bispecific antigen binding protein described herein can be used to identify a cell or cells that express TL1A and/or TNF-α. In a specific embodiment, the antigen binding protein is labeled with a labeling group and the binding of the labeled antigen binding protein to TL1A and/or TNF-α is detected. In a further specific embodiment, the binding of the antigen binding protein to TL1A and/or TNF-α is detected in vivo. In a further specific embodiment, the bispecific antigen binding protein is isolated and measured using techniques known in the art. See, for example, Harlow and Lane, 1988, Antibodies: A Laboratory Manual, New York: Cold Spring Harbor (ed. 1991 and periodic supplements); John E. Coligan, ed., 1993, Current Protocols In Immunology New York: John Wiley & Sons.

Another aspect of the invention provides for detecting the presence of a test molecule that competes for binding to TL1A and/or TNF-α with the antigen binding proteins described herein. An example of one such assay would involve detecting the amount of free antigen binding protein in a solution containing an amount of TL1A and/or TNF-α in the presence or absence of the test molecule. An increase in the amount of free antigen binding protein (i.e., the antigen binding protein not bound to TL1A and/or TNF-α) would indicate that the test molecule is capable of competing for TL1A and/or TNF-α binding with the bispecific antigen binding protein. In one embodiment, the antigen binding protein is labeled with a labeling group. Alternatively, the test molecule is labeled and the amount of free test molecule is monitored in the presence and absence of the antigen binding protein.

WORKING EXAMPLES

The invention is further illuminated by the following working examples, which exemplify but do not limit the scope of the invention

Example 1

Preparation of XenoMouse® Anti-TL1A Monoclonal Antibodies
Mouse Strains

Fully human antibodies to human TL1A were generated by immunizing XENOMOUSE® transgenic mice. U.S. Pat. Nos. 6,114,598; 6,162,963; 6,833,268; 7,049,426; 7,064,244, which are incorporated herein by reference in their entirety; Green et al. (1994), *Nature Genetics* 7:13-21; Mendez et al. (1997), *Nature Genetics* 15:146-156; Green and Jakobovitis (1998), *J. Ex. Med,* 188:483-495; Kellerman and Green (2002), *Current Opinion in Biotechnology* 13, 593-597; each of which is incorporated by reference in its entirety. Animals from the XMG1-KL, XMG2-K, XMG2-K/Balbc, XMG2-KL, XMG4-K and XMG4-KL XENOMOUSE® strains were used for all immunizations.
Generation of TL1A Immunogen TL1A polypeptides containing the N-terminal His tag (H6) of which the first 22 amino acids are the VK1 signal peptide) were generated by transiently transfecting 293HEK cells with the corresponding cDNAs. The commonly used polyHis tag was employed to facilitate detection and subsequent purification.

293-6E cells at $9.48 \times 10^5$ cells/ml were transfected with 0.5 mg/L DNA (0.1 mg/L His-TL1A in pTT5 vector with 0.4 mg/L empty pTT5 vector) (Durocher et al. (2002) NRCC, *Nucleic Acids. Res.* 30, e9) with 3 ml PEI/mg DNA in FreeStyle 293 media (Invitrogen). Tryptone N1 was added to cultures 1 hour after transfection. Cells were grown in suspension in FreeStyle 293 expression medium supplemented with 0.1% Pluronic F68 and 50 µg/ml Geneticin for 7 days and harvested for purification.

Example 2

Generation of TL1A

TL1A polypeptides containing the N-terminal His tag (H6) of which the first 22 amino acids are the VK1 signal peptide) were generated by transiently transfecting 293HEK cells with the corresponding cDNAs. The commonly used polyHis tag was employed to facilitate detection and subsequent purification.

293-6E cells at $9.48 \times 10^5$ cells/ml were transfected with 0.5 mg/L DNA (0.1 mg/L His-TL1A in pTT5 vector with 0.4 mg/L empty pTT5 vector) (Durocher et al. NRCC, Nucleic Acids. Res. (2002) 30, e9) with 3 ml PEI/mg DNA in FreeStyle 293 media (Invitrogen). Tryptone N1 was added to cultures 1 hour after transfection. Cells were grown in suspension in FreeStyle 293 expression medium supplemented with 0.1% Pluronic F68 and 50 µg/ml Geneticin for 7 days and harvested for purification.
Immunizations Immunizations are conducted using one or more suitable forms of TL1A antigen, including recombinant human TL1A expressed on cells and recombinant human TL1A soluble protein or combinations thereof.

A suitable amount of immunogen (i.e., 10 µg of protein delivered by injection to the abdomen) is used for initial immunization in XenoMouse®. Following the initial immunization, subsequent boost immunizations of immunogen (i.e., 2×10 e6 cells or 5 µg of protein) are administered on a schedule and for the duration necessary to induce a suitable titer of anti-TL1A antibody in the mice. Titers are determined by any suitable method, for example, enzyme immunoassay or fluorescence activated cell sorting (FACS).

Multiple immunogens and routes of immunization were used to generate anti-human TL1A immune responses. For genetic immunizations, mice were immunized 12-16 times over 6-8 weeks using the Helios Gene Gun system according to the manufacturer's instructions (BioRad, Hercules, Calif.). Briefly, expression vectors encoding wild type human or cynomolgus TL1A were coated onto gold beads (BioRad, Hercules, Calif.) and delivered to the epidermis of a shaved mouse abdomen. For cell-based immunizations, mice were immunized with a suspension-adapted CHO-K1 cell line (Invitrogen, Carlsbad, Calif.), stably transfected with an expression vector encoding human TL1A. Animals were immunized with cells mixed with Alum prepared from aluminum potassium sulfate (EMD Chemicals Inc., Gibbstown, N.J.) and CpG-ODN (Eurofins MWG Operon LLC, Huntsville, Ala.) 10-12 times over 6-8 weeks using a protocol that alternated between subcutaneous and intraperitoneal injections. The initial boost was comprised of $4 \times 10^6$ cells while subsequent boosts contained $2 \times 10^6$ cells. For soluble, recombinant protein immunizations, mice were immunized with a 6× His-tagged, trimeric form of the human and cynomolgus TL1A extracellular domain (amino acids 72-251 of the TL1A sequences). Animals were immunized with recombinant protein mixed with Alum and CpG-ODN, 8-12 times over 4-8 weeks using sub-cutaneous injections. The initial boost was comprised of 10 µg while subsequent boosts contained 5 µg. Human TL1A-specific serum titers were monitored by live-cell FACS analysis on an Accuri or FacsCalibur (BD Biosciences) flow cytometer. Animals with the highest antigen-specific serum titers directed against human and cynomolgus TL1A were sacrificed and used for hybridoma generation (Kohler and Milstein, 1975).

Example 3

Preparation of Monoclonal Antibodies
Hybridoma Generation

Animals exhibiting suitable titers are identified, and lymphocytes are obtained from draining lymph nodes and, if necessary, pooled for each cohort. Pooled lymphocytes (from each immunization cohort) were dissociated from lymphoid tissue by grinding in a suitable medium (for example, Dulbecco's Modified Eagle Medium (DMEM); Invitrogen, Carlsbad, Calif.). B cells may be selected and/or expanded using a suitable method, and fused with suitable fusion partner; for example, non-secretory myeloma P3X63Ag8.653 cells (American Type Culture Collection CRL 1580; Kearney et al *J. Immunol.* 123, 1979, 1548-

1550), using techniques that are known in the art. B cells were selected and/or expanded using standard methods, and fused with a suitable fusion partner using techniques that were known in the art.

In one suitable fusion method, lymphocytes are mixed with fusion partner cells at a ratio of 1:4. The cell mixture is gently pelleted by centrifugation at 400×g for 4 minutes, the supernatant decanted, and the cell mixture gently mixed (for example, by using a 1 ml pipette). Fusion is induced with PEG/DMSO (polyethylene glycol/dimethyl sulfoxide; obtainable from Sigma-Aldrich, St. Louis Mo.; 1 ml per million lymphocytes). PEG/DMSO is slowly added with gentle agitation over one minute followed, by one minute of mixing. IDMEM (DMEM without glutamine; 2 ml per million B cells), is then added over 2 minutes with gentle agitation, followed by additional IDMEM (8 ml per million B-cells) which is added over 3 minutes.

The fused cells are gently pelleted (400×g, 6 minutes) and resuspended in 20 ml Selection media (for example, DMEM containing Azaserine and Hypoxanthine [HA] and other supplemental materials as necessary) per million B-cells. Cells are incubated for 20-30 minutes at 37 C and then resuspended in 200 ml Selection media and cultured for three to four days in T175 flasks prior to 96-well plating.

Cells are distributed into 96-well plates using standard techniques to maximize clonality of the resulting colonies. After several days of culture, supernatants are collected and subjected to screening assays as detailed in the examples below, including confirmation of binding to human TL1A, evaluation of cross-reactivity with other species' TL1A (for example, cynomologous monkey TL1A), and ability to inhibit the activity of TL1A. Positive cells are further selected and subjected to standard cloning and subcloning techniques. Clonal lines may be expanded in vitro, and the secreted human antibodies obtained for analysis.

In this manner, mice were immunized with recombinant human TL1A soluble protein for a total of 15 immunizations over a period of approximately 2 months; several hybridoma cell lines secreting TL1A-specific antibodies were obtained, and the antibodies were further characterized. The sequences thereof are presented in the Sequence Listing and in Tables A, C and D and results of various tests using these antibodies are shown herein.

Tables A to E herein show the sequences of anti-TL1A antibodies prepared in accordance with this working example.

Example 4

Antigen Enrichment of Hybridoma Pools

Fused hybridoma pools from select immune tissue harvest were used as a source of material for FACS-based enrichments. To enrich for hybridomas expressing antibodies specific to native (full length, on-cell) human TL1A membranes were prepared from 293T cells transiently expressing the TL1A cDNA construct. 24 hours after transfection using 293Fectin™ (ThermoFisher Scientific Inc.) cells were biotinylated with E-Z link NHS-LC-LC-Biotin according to the manufacturer's recommendation (ThermoFisher Scientific Inc.). After biotinylation, cells were homogenized with a needle and syringe to form membrane fragments and referred to as "membrane preps". The biotinylated membrane preps were then used to detect hybridomas expressing surface antibodies specific to the target of interest via standard biotin-streptavidin chemistry.

To enrich hybridoma pools for the antigen of interest, they were first incubated with the membrane prep probe. Unbound probe was then washed away and the antigen-specific hybridomas were identified by simultaneous detection of surface IgG (with an Alexa 488 conjugated Gt anti-human Fc secondary antibody; Jackson ImmunoResearch) and the biotinylated membrane prep TL1A probe (Alexa Fluor 647 conjugated streptavidin; Jackson ImmunoResearch). Hybridomas expressing surface IgG and binding antigen were detected by FACS analysis on an Accuri flow cytometer. Dual positive events were sorted as single cells into 384-well plates on a FACS Aria cell sorter (BD Biosciences). After several days of culture, the hybridoma supernatants containing monoclonal antibodies were collected and used in the screening assays described in the examples below.

Example 5

Initial Selection of TL1A-Specific Binding Antibodies

Human TL1A was expressed on host Human Embryonic Kidney 293 cells by transfection using an expression vector expressing huTL1A cDNA, Gibco™ Opti-MEMO media (Gibco, Cat. No. 31985088) and 293Fectin™ reagent (Invitrogen, Cat. No. 12347019) following the protocol set out by the manufacturer. Hybridoma supernatants were screened for the presence of huTL1A-specific monoclonal antibodies using the FMAT 8200 Screening System (Molecular Devices) and the CellInsight™ High Content Imaging Platform (ThermoFisher Scientific). The number of huTL1A positive wells (i.e., those that have signal over irrelevant hybridoma supernatant) is presented in Table 5.1. For CellInsight screens, 15 µl/well of hybridoma supernatant (and positive and negative controls) were added to black, 384-well, clear bottom plates (Corning Can. No. 3712) followed by the addition of 30 µl/well of a mixture of TL1A/293T cells, nuclear Hoescht stain (Pierce, Cat. No. 62249) and Alexa 488-goat anti-human IgG (H+L) (Jackson, Cat. No. 109-545-088). After 3 hours of incubation at room temperature, plates were washed 2 times on an AquaMax 4000 plate washer (fitted with a 384-well cell wash head) and read on the CellInsight instrument according to the manufacturer's recommendations. For FMAT-based screens, 20 µl/well of hybridoma supernatant (and positive and negative controls) were added to black, 384-well, clear bottom plates followed by addition of 40 µl/well of a mixture of TL1A/293T cells, 293T parental cells and Cy5-goat anti-human IgG (Fc) (Jackson, Cat. No. 109-075). After 3 hours of incubation at room temperature, plates were read on the FMAT 8200 system according to the manufacturer's recommendations.

TABLE 5.1

TL1A-specific antibodies selected

| Harvest # | Platform | Total # Positive |
|---|---|---|
| 1 | FMAT 8200 | 1488 |
| 2 | FMAT 8200 | 900 |
| 5 | Cellinsight | 1830 |
| 6 | FMAT 8200 | 438 |
| 7&8 | Cellinsight | 1541 |

Example 6

Identification of TL1A Receptor-Ligand Blocking Antibodies

Biotinylated huTL1A was prepared by reacting 100 µg/ml of NHS LC LC biotin (Pierce, Cat. No. 21338) and 100 µg huTL1A (prepared as described in Example 2) in 1 ml of PBS pH 8.5 for 1 hr at room temperature. Un-reacted biotin was removed by ultra-filtration using a 5 kDa Amicon Ultra spin column (Millipore, Cat. No. UFC8 005). Hybridoma supernatants containing huTL1A-binding antibodies were assayed for their ability to block huTL1A binding to human Death Receptor 3 (huDR3) via an ELISA-based receptor-ligand assay. ELISA plates (Corning Cat. No. 3702) were coated with 40 µl/well of human DR3-Fc chimera (1 µg/ml) (R&D Systems, Cat. No. 943-D3) in coating buffer (lx PBS/0.05% azide), then incubated overnight at 4° C. Plates were then washed with water 3 times and blocked with 90 µl diluent (lx PBS/1% milk) for 30 min at room temperature. 15 µl of anti-TL1A hybridoma supernatant was preincubated with 45 µl of biotinylated TL1A (30 ng/ml final) in 96-well storage plates (Sigma, Cat. No. P6866) in assay diluent for 2 hr at room temperature prior to adding to the pre-blocked DR3 ELISA plates. Assay plates were then incubated for 1 hr at room temperature. Sample plates were subsequently washed 3 times followed by the addition of 40 µl/well of streptavidin-HRP (Pierce, Cat. No. 21126) and another 1 hr incubation at room temperature. Plates were washed an additional three times and 40 µl TMB (Neogen, Cat. No. 308177) was added. The TMB reaction was incubated for 30 min at room temperature and then quenched with 40 µl/well of 1 N hydrochloric acid. Finally, plates were read on an ELISA plate reader at a wavelength of 450 nm. Cutoffs were set at <38% of signal of negative control, irrelevant ESNs (exhausted supernatants). The numbers of samples able to block the huTL1A-DR3 interaction (as defined by this cutoff) are indicated in Table 6.1.

TABLE 6.1

Selected TL1A/DR3 blockers

| Harvest # | Total # TL1A/DR3 blockers |
|---|---|
| 1 | 208 |
| 2 | 39 |

Example 7

TL1A Functional Blocking Assays

In order to screen for hybridomas capable of blocking TL1A functional activity, IFNγ release from primary T cells or a NF-κB reporter assay in TF1 cells were employed. For the IFNγ release assay, purified primary human T cells (Biological Speciality Corp., Cat. #215-01-10) were stimulated with soluble human TL1A in the presence or absence of hybridoma supernatants specific to TL1A. $2 \times 10^5$ primary human T cells were stimulated with 8-16 ng/mL human TL1A (Amgen), 1-2 ng/mL IL-12 (Peprotech) and 0.5-1 ng/mL IL-18 (R&D Systems) in the presence of hybridoma supernatants containing anti-TL1A antibodies in 96-well round bottom plate at 37° C. for 72 hours. Culture supernatants were then tested for IFNγ level by ELISA according to the manufacturer's instructions (R&D Systems). For the TL1A responsive reporter assay, a TF-1 NF-κB reporter cell line (Amgen) was stimulated with soluble or membrane-bound human TL1A or soluble cynomolgus monkey TL1A. 0.2-3 nM or 2-20 nM of soluble human or cynomolgus monkey TL1A (respectively) was incubated with $10^4$-$10^5$ TF-1 NF-κB reporter cells in the presence of serially diluted hybridoma supernatants (or controls) in 96 or 384-well plates at 37° C. overnight. For testing samples against membrane-bound TL1A, activity assays were performed by co-culturing the TF-1 NF-κB reporter cell line with human TL1A-expressing AMID cells. $10^5$ TF-1 NF-κB reporter cells and $10^3$ AMID cells were co-cultured in the presence of 5 ug/mL of anti-TL1A antibody (or controls) in a 384-well plate at 37° C. overnight. Reporter signal in each well was determine using the Steady-Glo Luciferase Assay System according to the manufacturer's recommendation (Promega).

Example 8

Molecular Rescue and Sequencing of TL1A Receptor-Ligand Blocking Antibodies

RNA (total or mRNA) was purified from wells containing the TL1A-neutralizing antibody-producing hybridoma cells using a Qiagen RNeasy mini or the Invitrogen mRNA catcher plus kit. Purified RNA was used to amplify the antibody heavy and light chain variable region (V) genes using cDNA synthesis via reverse transcription, followed by a polymerase chain reaction (RT-PCR). The fully human antibody gamma heavy chain was obtained using the Qiagen One Step Reverse Transcriptase PCR kit (Qiagen). This method was used to generate the first strand cDNA from the RNA template and then to amplify the variable region of the gamma heavy chain using multiplex PCR (see Table 8.1 for the complete primer list, SEQ ID NOS: 1191 to 1252, respectively). The 5' gamma chain-specific primer annealed to the signal sequence of the antibody heavy chain, while the 3' primer annealed to a region of the gamma constant domain. The fully human kappa light chain was obtained using the Qiagen One Step Reverse Transcriptase PCR kit (Qiagen). This method was used to generate the first strand cDNA from the RNA template and then to amplify the variable region of the kappa light chain using multiplex PCR. The 5' kappa light chain-specific primer annealed to the signal sequence of the antibody light chain while the 3' primer annealed to a region of the kappa constant domain. The fully human lambda light chain was obtained using the Qiagen One Step Reverse Transcriptase PCR kit (Qiagen). This method was used to generate the first strand cDNA from the RNA template and then to amplify the variable region of the lambda light chain using multiplex PCR. The 5' lambda light chain-specific primer annealed to the signal sequence of light chain while the 3' primer annealed to a region of the lambda constant domain.

The amplified cDNA was purified enzymatically using exonuclease I and alkaline phosphatase and the purified PCR product was sequenced directly. Amino acid sequences were deduced from the corresponding nucleic acid sequences bioinformatically. Two additional, independent RT-PCR amplification and sequencing cycles were completed for each hybridoma sample in order to confirm that any mutations observed were not a consequence of the PCR. The derived amino acid sequences were then analyzed to determine the germline sequence origin of the antibodies and to identify deviations from the germline sequence. The amino acid sequences corresponding to CDRs of the sequenced antibodies were aligned and these alignments were used to group the clones by similarity.

TABLE 8.1

Multiplex primers used to amplify antibody V genes.

| Heavy Chain | | SEQ ID |
|---|---|---|
| | Sequence 5' to 3' | NO. |
| 5' primer | C ACC ATG GAC TGG ACC TGG AGG ATC | 1191 |
| | C ACC ATG GAC TGG ACC TGG AGC ATC | 1192 |
| | C ACC ATG GAC TGC ACC TGG AGG ATC | 1193 |
| | C ACC ATG GAC TGG ACC TGG AGA ATC | 1194 |
| | C ACC ATG GAC TGG ACC TGG AGG G | 1195 |
| | C ACC ATG GAC TGG ATT TGG AGG ATC C | 1196 |
| | C ACC ATG GAC ACA CTT TGC TCC ACG | 1197 |
| | C ACC ATG GAC ACA CTT TGC TAC ACA CTC C | 1198 |
| | C ACC ATG GAG TTT GGG CTG AGC TG | 1199 |
| | C ACC ATG GAA TTG GGG CTG AGC TG | 1200 |
| | C ACC ATG GAG TTG GGG CTG AGC TG | 1201 |
| | C ACC ATG GAA CTG GGG CTC CGC | 1202 |
| | C ACC ATG GAA TTT GGG CTG AGC TGG | 1203 |
| | C ACC ATG GAG TTG GGG CTG TGC TG | 1204 |
| | C ACC ATG GAG TTT GGG CTT AGC TGG | 1205 |
| | C ACC ATG GAG TTT TGG CTG AGC TGG | 1206 |
| | C ACC ATG AAA CAC CTG TGG TTC TTC CTC | 1207 |
| | C ACC ATG AAG CAC CTG TGG TTC TTC C | 1208 |
| | C ACC ATG AAA CAT CTG TGG TTC TTC CTT CTC | 1209 |
| | C ACC ATG GGG TCA ACC GCC ATC C | 1210 |
| | C ACC ATG TCT GTC TCC TTC CTC ATC TTC | 1211 |
| 3' primer | GCTGAGGGAGTAGAGTCCTGAGGACTGT | 1212 |

| Kappa chain | | SEQ ID |
|---|---|---|
| | Sequence 5' to 3' | NO. |
| 5' primer | C ACC ATG GAC ATG AGG GTC CCC G | 1213 |
| | C ACC ATG GAC ATG AGG GTC CCT GC | 1214 |
| | C ACC ATG GAC ATG AGG GTC CTC GC | 1215 |
| | C ACC ATG AGG CTC CCT GCT CAG C | 1216 |
| | C ACC ATG AGG CTC CTT GCT CAG CTT C | 1217 |
| | C ACC ATG GAA ACC CCA GCG CAG C | 1218 |
| | C ACC ATG GAA GCC CCA GCG CAG | 1219 |
| | C ACC ATG GAA GCC CCA GCT CAG | 1220 |
| | C ACC ATG GAA CCA TGG AAG CCC CAG | 1221 |
| | C ACC ATG GTG TTG CAG ACC CAG GTC | 1222 |
| | C ACC ATG GGG TCC CAG GTT CAC C | 1223 |
| | C ACC ATG TTG CCA TCA CAA CTC ATT GGG | 1224 |
| | C ACC ATG GTG TCC CCG TTG CAA TTC | 1225 |
| 3' primer | ACCCGATTGGAGGGCGTTATCCACC | 1226 |

| Lambda chain | | SEQ ID |
|---|---|---|
| | Sequence 5' to 3' | NO. |
| Sense (5') | C ACC ATG GCC TGG TCC CCT CTC | 1227 |
| | C ACC ATG GCC TGG TCT CCT CTC C | 1228 |
| | C ACC ATG GCC AGC TTC CCT CTC C | 1229 |
| | C ACC ATG GCC TGG GGC TTC CCT CTC | 1230 |
| | C ACC ATG ACC TGC TCC CCT CTC C | 1231 |
| | C ACC ATG GCC TGG GCT CTG CTC | 1232 |
| | C ACC ATG GCC TGG GCT CTG CTG | 1233 |
| | C ACC ATG GCA TGG ATC CCT CTC TTC | 1234 |
| | C ACC ATG GCC TGG ACC GCT CTC | 1235 |
| | C ACC ATG GCC TGG ACC CCT CTC | 1236 |
| | C ACC ATG GCC TGG ATC CCT CTC C | 1237 |
| | C ACC ATG GCC TGG ACC GTT CTC C | 1238 |
| | C ACC ATG GCA TGG GCC ACA CTC C | 1239 |
| | C ACC ATG GCC TGG ATC CCT CTA C | 1240 |
| | C ACC ATG GCC TGG GTC TCC TTC TAC | 1241 |
| | C ACC ATG GCC TGG ACC CAA CTC C | 1242 |
| | C ACC ATG GCT TGG ACC CCA CTC C | 1243 |
| | C ACC ATG GCC TGG ACT CCT CTC C | 1244 |
| | C ACC ATG GCC TGG ACT CCT CTT CTT C | 1245 |
| | C ACC ATG GCC TGG ACT CTT CTC CTT C | 1246 |
| | C ACC ATG GCC TGG GCT CCA CTA C | 1247 |

TABLE 8.1-continued

```
Multiplex primers used to amplify antibody V genes.
                C ACC ATG GCC TGG ACT CCT CTC TTT C       1248
                C ACC ATG GCC TGG ATG ATG CTT CTC C       1249
                C ACC ATG GCC TGG GCT CCT CTG             1250
                C ACC ATG CCC TGG GCT CTG CTC             1251
Anti-Sense (3') GGA GGG TKT GGT GGT CTC CAC TCC C         1252
```

(where K = G + T)

Example 9

Preparation of Hetero Ig Constructs

Generation of a bispecific antibody through co-expression of two different antibodies leads to contaminants primarily consisting of mispaired heavy and light chains. The preferred bispecific, heterotetramer molecule with two different heavy chains associated with correctly paired light chains is only a minority of the total amount of combinations that can assemble. The contaminants occur mainly due to two different reasons. The first reason is that the heavy chain that comes together at the Fc region of the antibody can homodimerize, leading to conventional monospecific antibody, or heterodimerize, leading to a potential bispecific antibody. The second reason is that light chain is promiscuous and can pair with either of the heavy chains, leading to mispaired light-heavy chain Fab assembly that may not retain binding to the desired target. For these reasons, the bispecific engineering is a two-step process. The first goal is to prevent the homodimerization of the heavy chains and encourage heterodimerization. This can be achieved through engineering the Fc region of the antibodies, using, for example, the knobs-into-holes or charge pair mutations strategies. The second goal is to engineer the light-heavy chain interface in such a way that the light chain is specifically associated only with its cognate heavy chain.

The "Hetero-Ig" platform technology (see, e.g., WO2009089004 and WO2014081955, both of which are hereby incorporated by reference in their entireties) takes advantage of the electrostatic steering mechanism to overcome the pairing problems mentioned above. Specifically, charged residues are introduced or exploited to drive heavy chain heterodimerization and correct light-heavy chain association. The charge pair mutations (CPMs) in the CH3 domain of the Fc region drive the heterodimerization of the two different heavy chains through opposite charges that cause electrostatic attraction (see, e.g., WO2009089004 and U.S. Pat. No. 8,592,562); the two identical heavy chain combinations have identical juxtaposed charges and are therefore repelled.

The correct heavy chain-light chain pairing is facilitated by CPMs at the HC/LC binding interface or the HC1/HC2 binding interface (see FIG. 1). The correct heavy chain-light chain combinations will have opposite charges and therefore be attracted to each other, whereas the incorrect heavy chain-light chain combinations will have the same charges juxtaposed, resulting in repulsion. In FIG. 1, correctly assembled hetero-Ig molecules have two or three HC1/HC2 CPMs and two to four HC/LC CPMs that drive the assembly of the preferred heterotetramer comprising two different heavy chains and two different light chains so that the heterotetramer will be the majority component generated by the expression system. The DNAs encoding anti-TL1A/anti-TNF-α hetero Ig-s contain fragments coding for anti-TL1A (or anti-TNF-α) heavy chain and anti-TNF-α (or anti-TL1A) Fab. The DNAs were cloned into pTT5.1 vector. These expression vectors were then used to transfect and express anti-TL1A/anti-TNF-α bi-specifics in human 293 6E cells.

Anti-TNF-α antibodies 3.2, 234 and certolizumab were used with anti-TL1A antibodies 3B3, 2G11, 23B3 VH3, 23B3 VH4, and 3C6 to engineer hetero Ig molecules as described in Table J using high throughput cloning, expression and purification. Each of the bispecific hetero Ig molecules had one of the four formats shown in FIG. 1 using the IgG1 effector functionless scaffold or an IgG2 scaffold. Preferred IgG molecules incorporate the charge mutations shown in FIG. 1 (v2), which are shown in Table M. The IgG1 effector functionless scaffold comprises substitutions R292C and V302C and may also comprise substitution N297G (also known as the SEFL2 scaffold).

Example 10

Method for Expression and Purification of Anti-TL1A/Anti-TNFα Hetero-Ig Molecules Hetero-Ig expression was performed via transient transfection of 293-6E cells. One day prior to transfection N-1 culture was set up in a 20 L Wave bag, at 36° C.-37° C., 5% $CO_2$, 0.2 LPM overlay with a total volume of 9 L of culture at 8.5 E5 vc/mL in Freestyle F-17 media (Thermo Fisher). The transfection complex was then prepared by mixing FreeStyle F-17 media, pre-warmed with 0.5 mg/L transfection DNA, with a 1:1:1:1 plasmid DNA chain ratio. Transfection complex (media+DNA+PEI reagent) volume was 10% of final culture volume. Four hours post-transfection, a feed of yeastolate and glucose was added. Culture was harvested on day six at 2.11 E6 cells/mL and 78.2% viability. Expression titer was measured using the ForteBio Octet Q System at 84.0 mg/L. The conditioned media was harvested by centrifugation and filtered using 0.2 μm cellulose acetate filter using a peristaltic pump.

Figure 3:
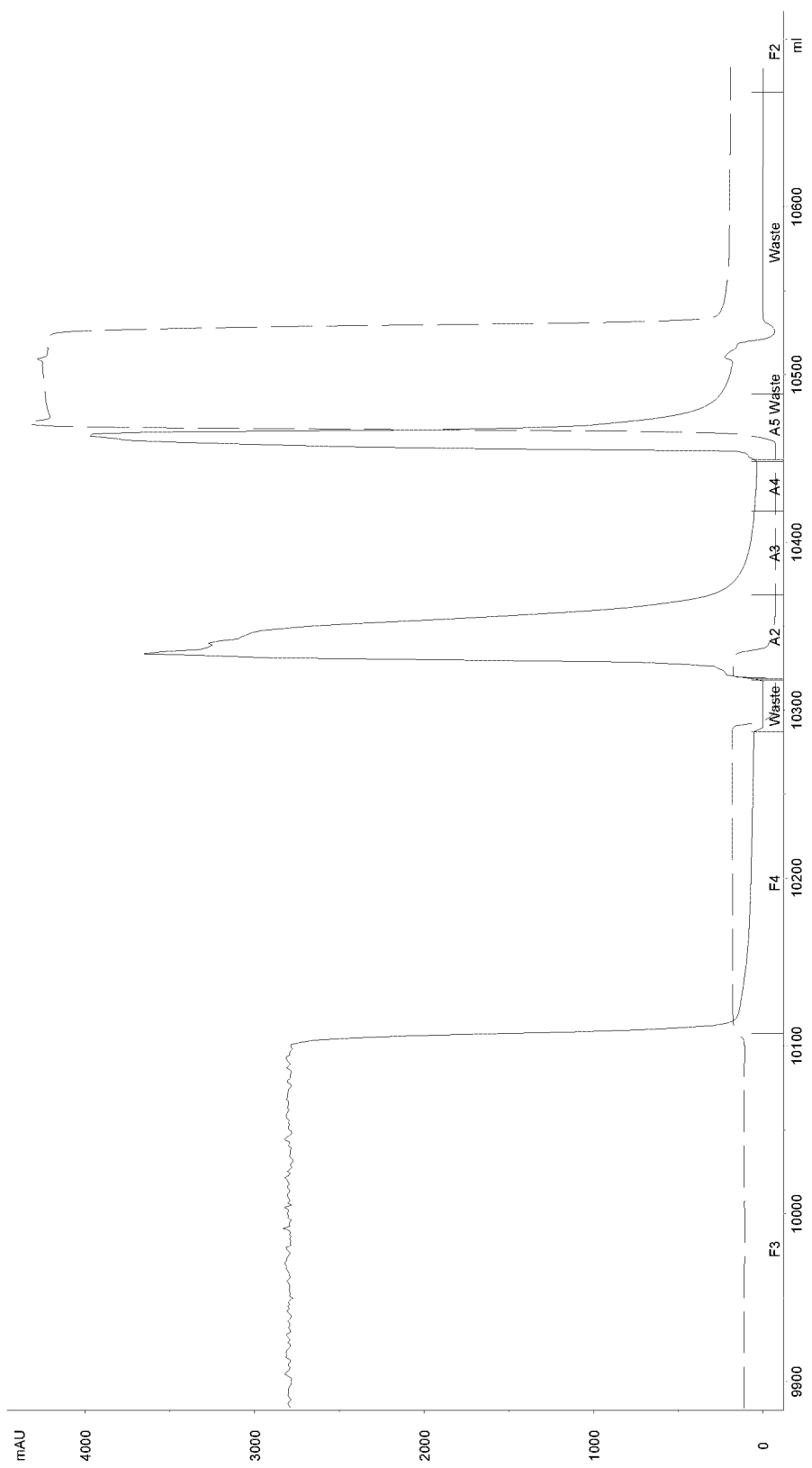
FIG. 3 concerns MabSelect SuRe affinity chromatography of an anti-TL1A/anti-TNF-α Hetero-Ig. It shows a representative FPLC protein A affinity capture chromatogram of an anti-TL1A/anti-TNF-α hetero-Ig. The protein was eluted with a step gradient of 100 mM acetic acid (conductivity: black trace, dashed), pH 3.6 and pooled based on the A280 (black trace, solid).
Figure 4:
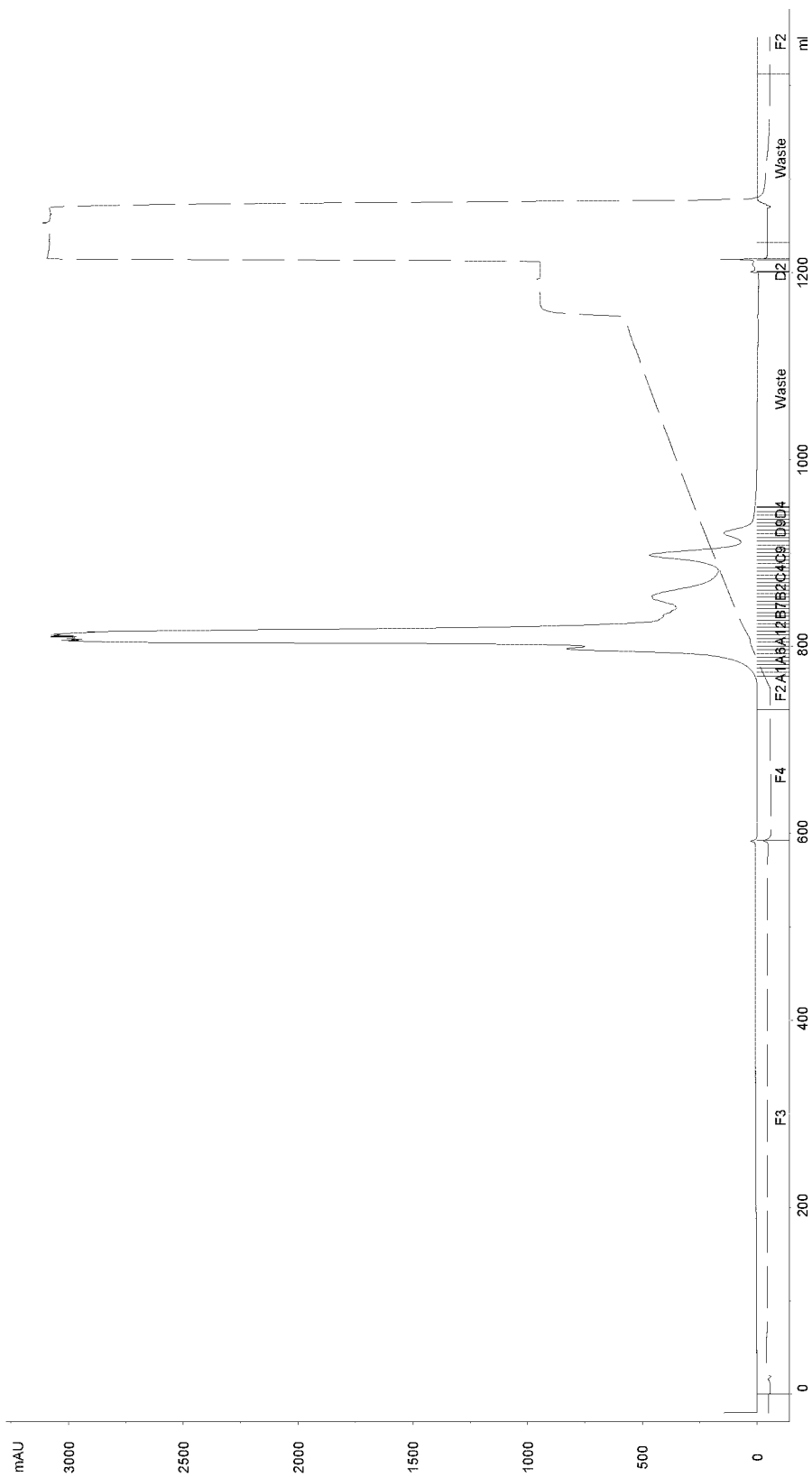
FIG. 4 shows a representative FPLC SP high performance sepharose purification chromatogram of an anti-TL1A/anti-TNF-α hetero-Ig. Protein was eluted with an increasing salt gradient (conductivity: black trace, dashed) and was pooled based on the A280 elution profile (black trace, solid) and Caliper LabChip analysis of fractions.
Figure 5:
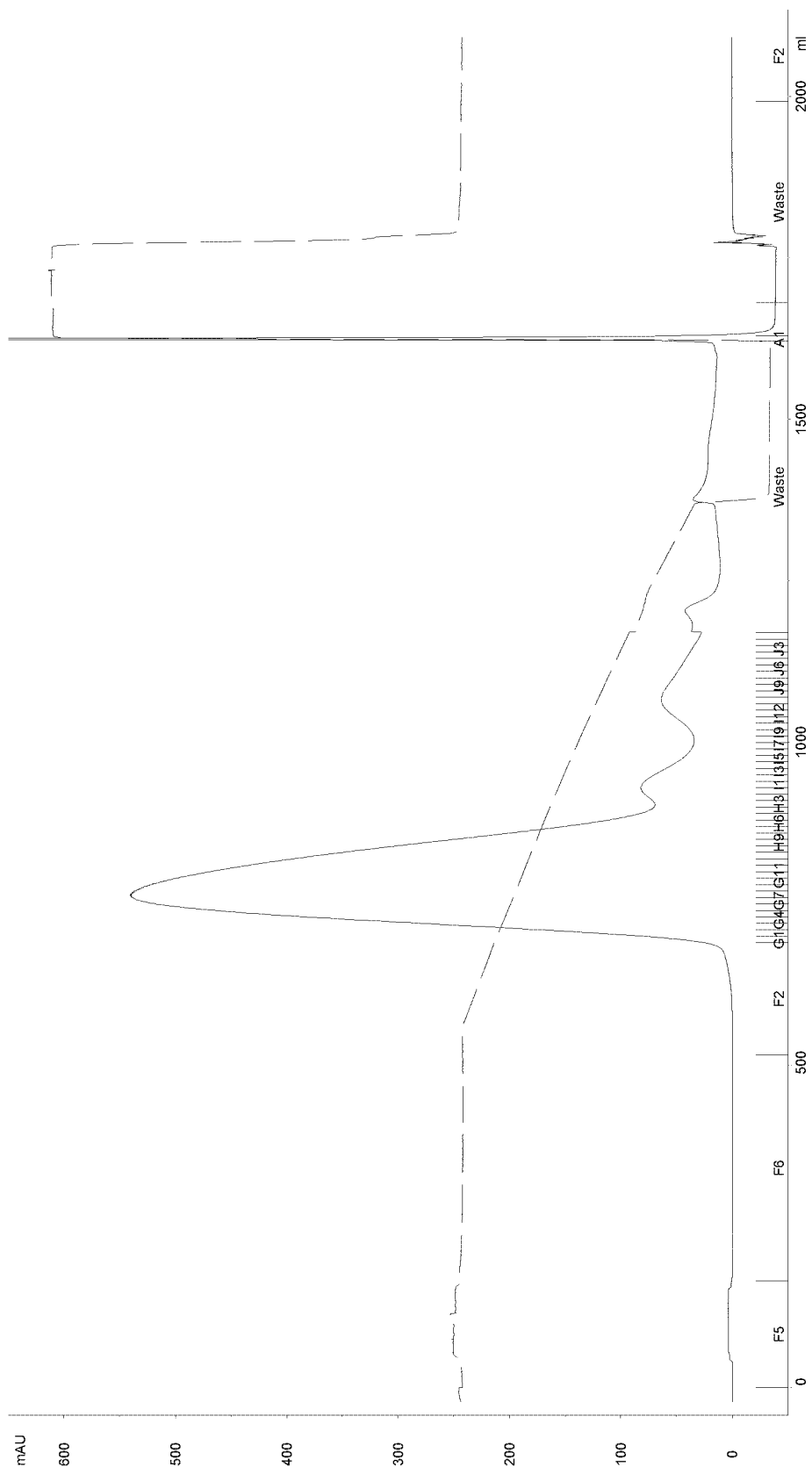
FIG. 5 shows a representative FPLC SP high performance sepharose purification chromatogram of an anti-TL1A/anti-TNF-α hetero-Ig. Protein was eluted with decreasing ammonium sulfate gradient (conductivity: black trace, dashed) and pooled based on the A280 elution profile (black trace, solid) and Caliper LabChip analysis of fractions.
Figure 6:
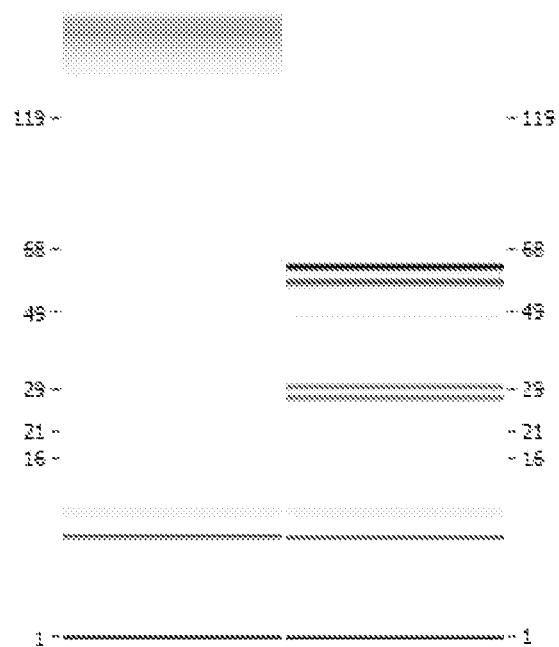
FIG. 6 concerns Caliper analysis of a TL1A/TNF-α hetero-Ig. It shows non-reduced and reduced Caliper analysis of an anti-TL1A/anti-TNF-α hetero-Ig.
Figure 7:
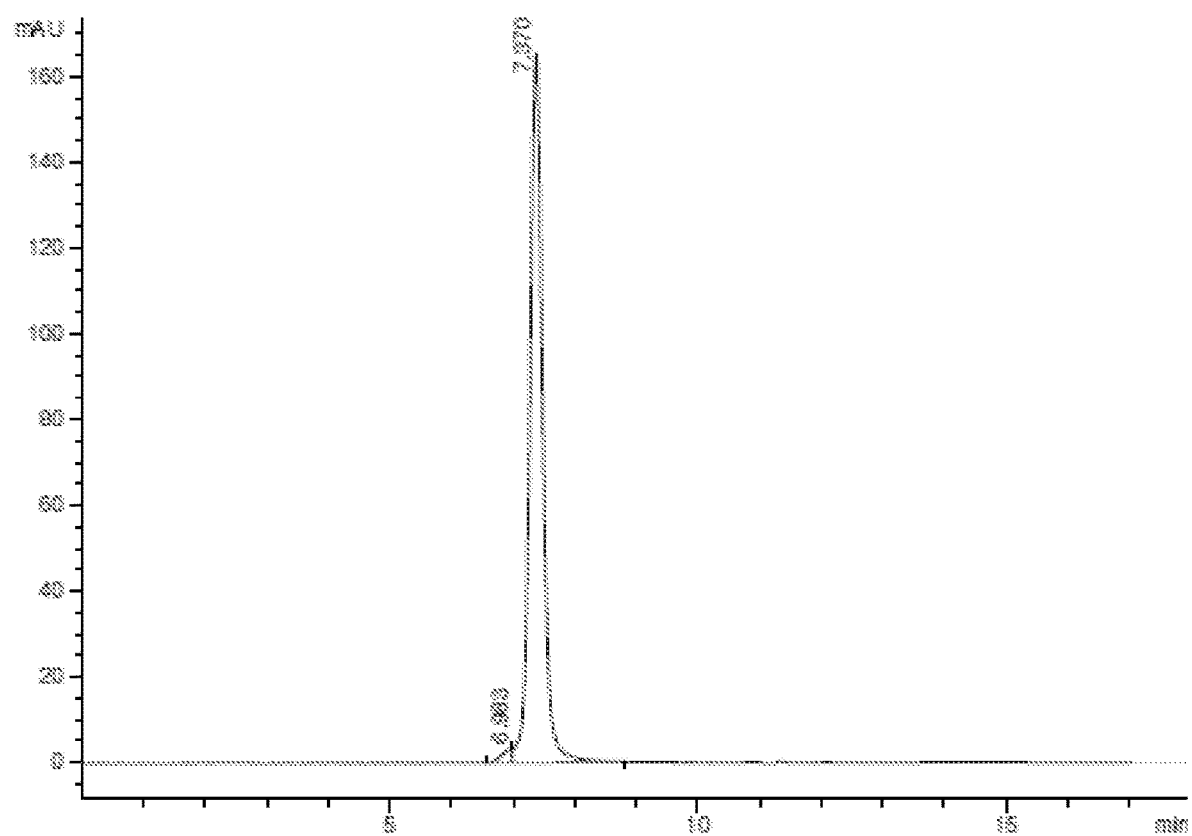
FIG. 7 concerns SE-HPLC analysis of an anti-TL1A/anti-TNF-α hetero-Ig. It shows size exclusion chromatography on 30 μg of the final anti-TL1A/anti-TNF-α hetero-Ig product injected onto a Sepax Zenix-C SEC-300 column (7.8×300 mm) in 50 mM $NaH_2PO_4$, 250 mM NaCl, pH 6.9 at 1 ml/min, observing the absorbance at 280 nm (black trace).

For purification, the hetero-Ig molecules were affinity captured by MabSelect SuRe chromatography (GE Life Sciences, Piscataway, N.J.), using Dulbecco's PBS without divalent cations (Invitrogen, Carlsbad, Calif.) as the wash buffer and 100 mM acetic acid, pH 3.6 as the elution buffer (FIG. 3). All separations were carried out at ambient temperature. The elution peak was pooled based on the chromatogram, neutralized to pH 7.0 using 2 M tris base, diluted with 5-volumes water, and filtered through a 0.22 μm cellulose acetate filter. To remove half antibody species, the sample was then loaded on to an SP-HP sepharose column (GE Life Sciences, Piscataway, N.J.) and washed with 8 column volumes of SP-Buffer A (20 mM sodium phosphate, pH 7.0) followed by elution using a 20 column volume gradient to 60% SP-Buffer B (20 mM sodium phosphate, 1 M NaCl, pH 7.0) (FIG. 4). A pool was made based on the chromatogram and Caliper LabChip (Perkin Elmer, Waltham, Mass.) analysis of fractions. The pool was conditioned with an equal volume of 2×HIC Buffer (200 mM sodium phosphate, 1.5 M ammonium sulfate, pH 7.0) and filtered through a 0.22 µm cellulose acetate filter. To remove mispaired species, the sample was loaded on to a Butyl-HP sepharose column (GE Life Sciences, Piscataway, N.J.) and washed with 8 column volumes of Butyl-Buffer A (50 mM sodium phosphate, 0.75 M ammonium sulfate, pH 7.0) followed by elution using a 20 column volume gradient to 100% Butyl-Buffer B (50 mM sodium phosphate, pH 7.0) (FIG. 5). A pool was made based on the chromatogram and Caliper LabChip (Perkin Elmer, Waltham, Mass.) analysis of fractions under non-reducing and reducing conditions. The pool was diafiltered against approximately 30 volumes of 10 mM sodium acetate, 9% sucrose, pH 5.2 using Slide-A-Lyzer dialysis cassettes with a 10 kDa cutoff membrane (Pierce, Rockford, Ill.) and further concentrated using a Vivaspin-20 centrifugal concentrator with a 10 kDa cutoff membrane (Sartorius Stedim Biotech, Goettingen, Germany). The concentrated material was then filtered through a 0.8/0.2 µm cellulose acetate filter and the concentration was determined by the absorbance at 280 nm using an extinction coefficient of approximately 212,000. Sample purity was determined by Caliper LabChip analysis under reducing (with 2% 2-mercaptoethanol) and non-reducing (with 25 mM iodoacetamide) conditions (FIG. 6). Analytical SEC was carried out using a Zenix-C SEC-300 column (Sepax Technologies, Newark, Del.) with an isocratic elution in 50 mM sodium phosphate, 250 mM NaCl, pH 6.9 over 18' (FIG. 7).

In order to assess both hetero-Ig integrity and confirm heavy chain-light chain pairing, LC-MS was performed on non-reduced hetero-Ig, as well as hetero-Ig after limited lysyl endoproteinase C (Wako, Richmond, Va.) digestion to produce the hetero-Ig Fab's (fragment antigen binding) regions of the hetero-Ig. Analysis of non-reduced hetero-Ig was performed by simple dilution of 30 µg native hetero-Ig sample, 1:1 in 0.1% TFA, and injecting 20 µg. Analysis of Fab's was achieved by incubation of hetero-Ig in the presence of lysyl endoproteinase C using a 1:400 enzyme/substrate ratio in the presence of 100 mM Tris, adjusted to pH8, for 30 minutes at 37° C. The reaction was then stopped by dilution in an equal volume of 0.1% TFA. Initial cleavage of antibody by Lysyl Endoproteinase C is just above the hinge disulfides after the lysine in the sequence motif SCDK/THTCPPC yielding Fab and Fc fragments.

Figure 8:
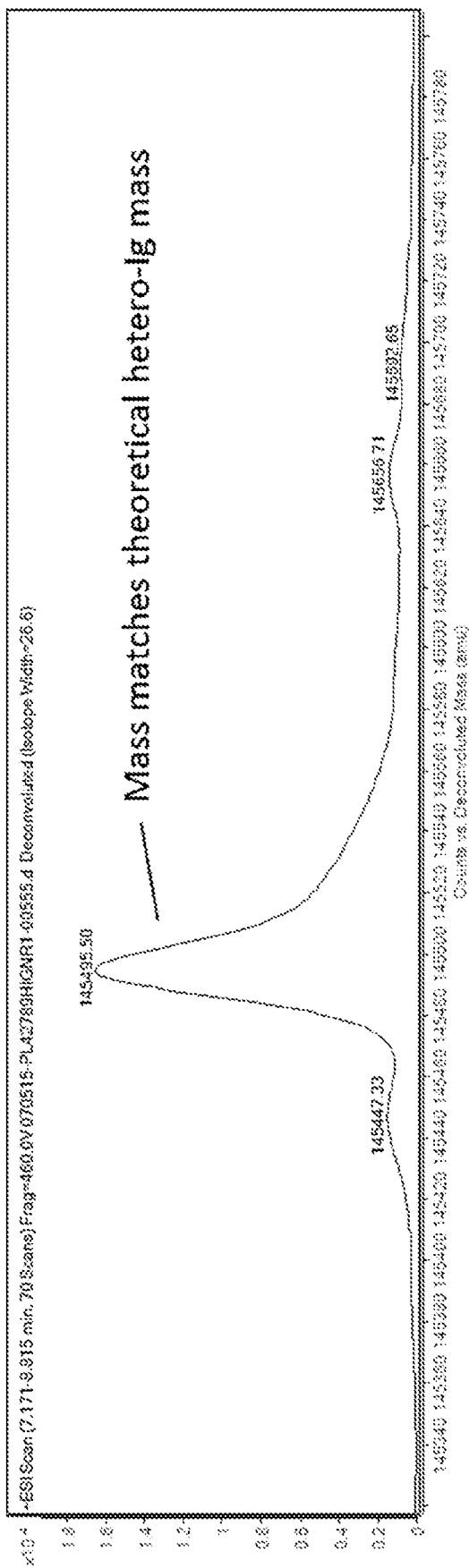
FIG. 8 concerns LC-MS of Non-Reduced Hetero-Ig (Theoretical mass: 145495 Da).

Mass analysis was performed using an Agilent 6230 ESI-TOF Mass Spectrometer and 1260 quaternary HPLC system equipped with a Zorbax 300SB-C8, 2.1×50 mm 3.5 µm column (Agilent, Santa Clara, Calif.). Mobile phase A consisted of 0.1% TFA, and mobile phase B consisted of 90% n-propanol, 0.1% TFA in water. Chromatographic gradient conditions for analysis of non-reduced hetero-Ig were as follows: 20% mobile phase B for 1 minute; 1-9 min, 20-70% B; 9-10 min, 70-100% B; 10-11 min, 100% B. Column temperature was kept at 75° C. and post column equilibration at 20% mobile phase B was performed for 7 minutes prior to injection of the next sample. The ESI-TOF settings were as follows: capillary voltage, 5900 V; gas temperature, 340° C.; dry gas, 13 L/min; nebulizer pressure, 25 psig; fragmentor voltage 460 V and skimmer voltage, 95 V (FIG. 8).

Figure 9:
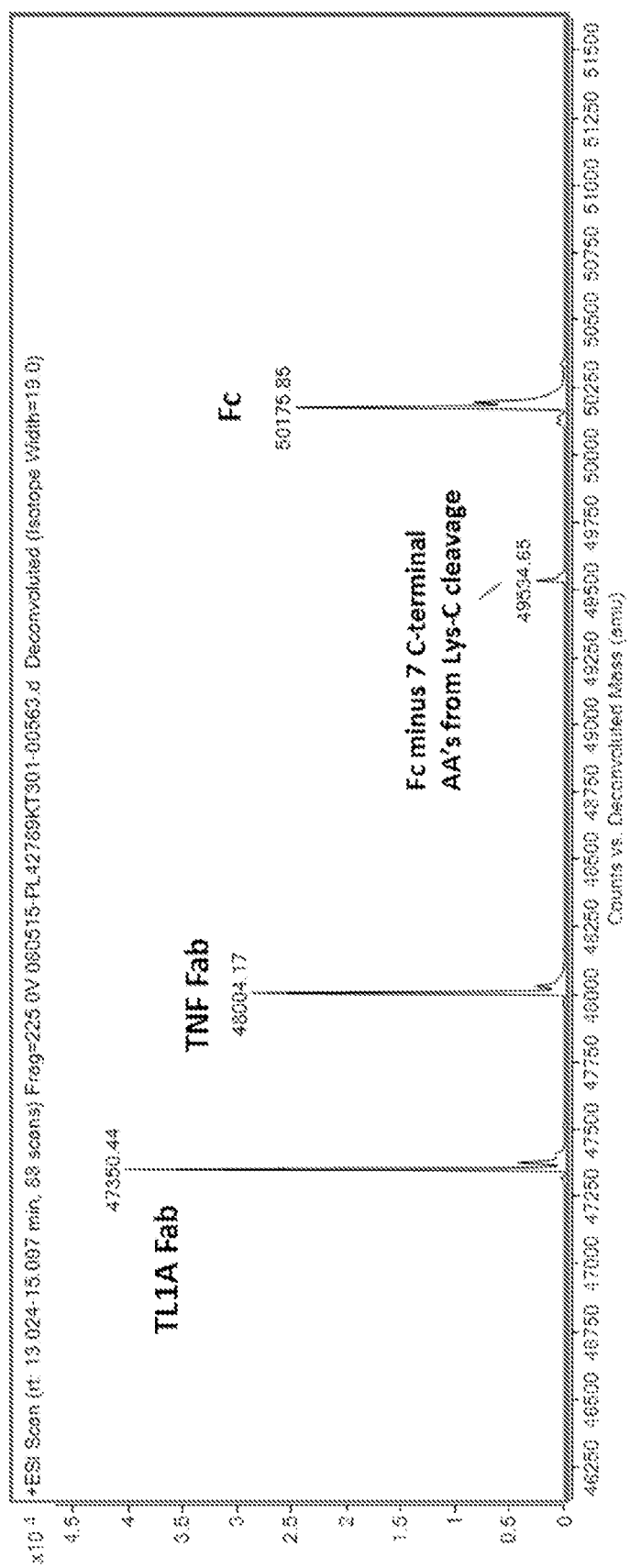
FIG. 9 shows mass analysis of 20 μg TL1A/TNF-α hetero-Ig after limited Lysyl Endoproteinase C digestion for 30 minutes in 100 mM TRIS, pH 8. Reverse-phase HPLC was conducted using an Agilent Zorbax 300SB-C8 column (2.1×50 mm 3.5 μm) and mobile phases of 0.1% TFA and 90% n-propanol/0.1% TFA (mobile phases A and B respectively) and mass detection on an Agilent 6230 ESI-TOF Mass Spectrometer. Theoretical masses for TL1A Fab, TNF Fab, and Fc are 47350 Da, 48002 Da, and 50175 Da, respectively.

Analysis of hetero-Ig digested with lysl endoproteinase C was conducted by injecting 20 µg onto the reverse-phase HPLC column and eluting using the following LC gradient: 2% mobile phase held for 2 minutes; 2-12 min, 2-45% B; 12-16 min, 45-90% B; 16-17 min 90% B. Column temperature was kept at 75° C. and post column equilibration at 20% mobile phase B was performed for 7 minutes prior to injection of the next sample (FIG. 9).

Example 11

Preparation of IgG-ScFv Constructs

Each anti-TL1A/anti-TNF-α IgG-scFv antigen binding protein consists of two antigen binding domains, one directed against TL1A and the other against TNF-α. The DNAs encoding anti-TL1A/anti-TNF-α IgG-scFv contain fragments coding for anti-TL1A (or anti-TNF-α) heavy chain (HC) in which the C-terminus is fused to anti-TNF-α (or anti-TL1A) antibody single chain Fv (scFv) (see FIG. 2) with or without cysteine clamp for the purpose of improving biophysical properties. In order to introduce the cysteine clamp, positions 44 (Kabat numbering) VH and 100 (Kabat numbering) in VL were mutated to cysteine. The DNAs were cloned into pTT5.1 vector. These expression vectors were then used to transfect and express anti-TL1A/anti-TNF-α bi-specifics in human 293-6E cells. Full sequences for anti-TL1A/anti-TNF-α IgG-scFv antigen binding proteins produced are shown in Tables L and M.

Example 12

Method for Purifying Anti-TL1A/Anti-TNFα IgG-scFv Molecules

IgG-ScFv expression was performed via transient 293 productions. One day prior to transfection, cultures were set up in eight 5 L Thompson Ultra Yield flasks, with a total volume of 2.250 L of culture at 8.5E5 vc/mL each in Freestyle F-17 media (Thermo Fisher). The cultures were kept at 36° C.-37° C., 5% $CO_2$ at and shaking at 120 RPM. The transfection complex was prepared by mixing FreeStyle F-17 media with 0.5 mg/L DNA, using a 20% of coding plasmid and 80% empty pTT5 vector and PEI at 10% final culture volume Four hours later a yeast lysate and glucose feed was added to each flask. Six days post transfection the cells were harvested through centrifugation, pooled and filtered. Average titer was measured by Forte Bio Octet at 25 mg/L.

Figure 10:
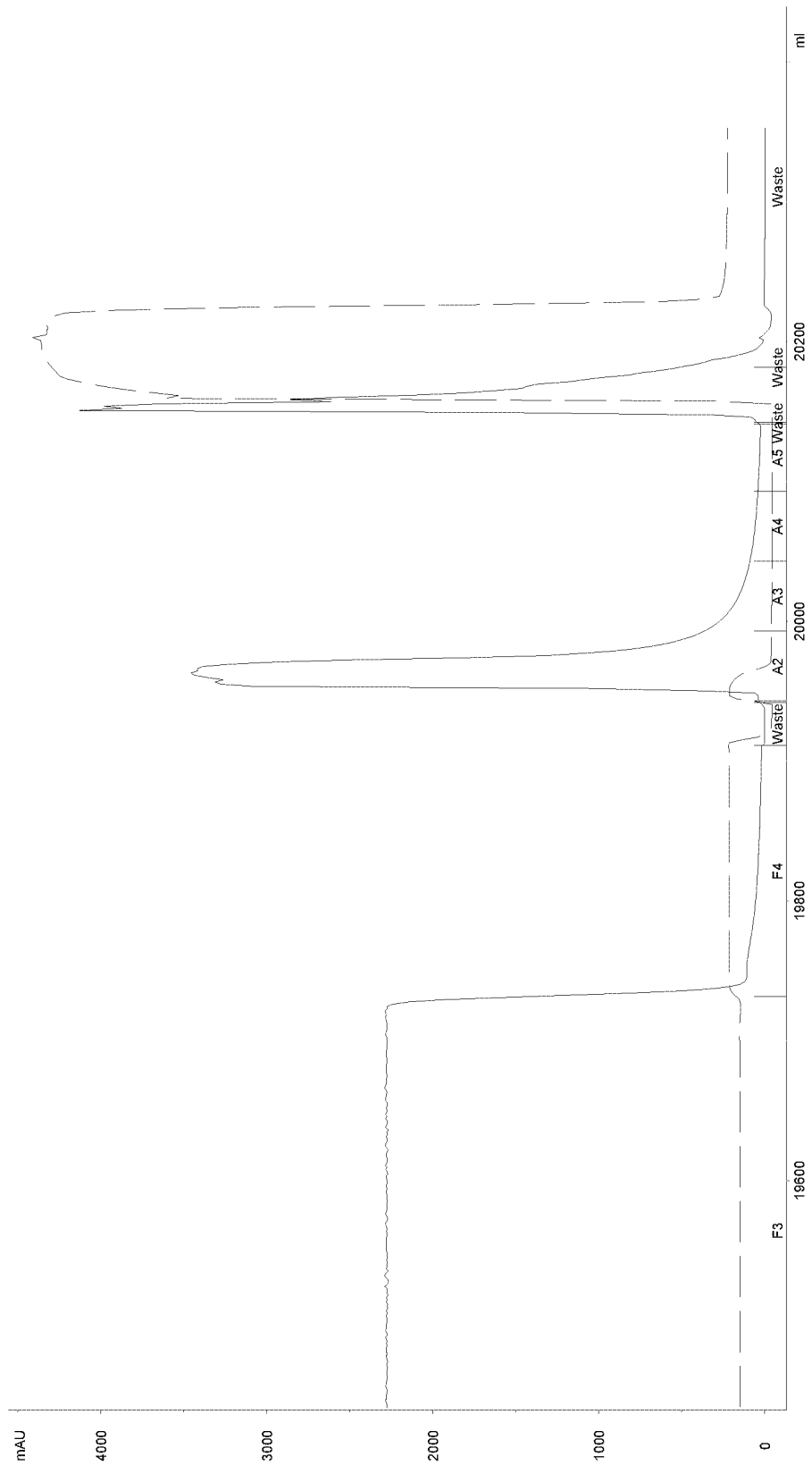
FIG. 10 concerns MabSelect SuRe affinity chromatography of a anti-TL1A/anti-TNF-α IgG-scFv. It shows a representative FPLC protein A affinity capture chromatogram of an anti-TL1A/anti-TNF-α IgG-scFv. The protein was eluted with a step gradient of 100 mM acetic acid, pH 3.6 and pooled based on the A280 (black trace).
Figure 11:
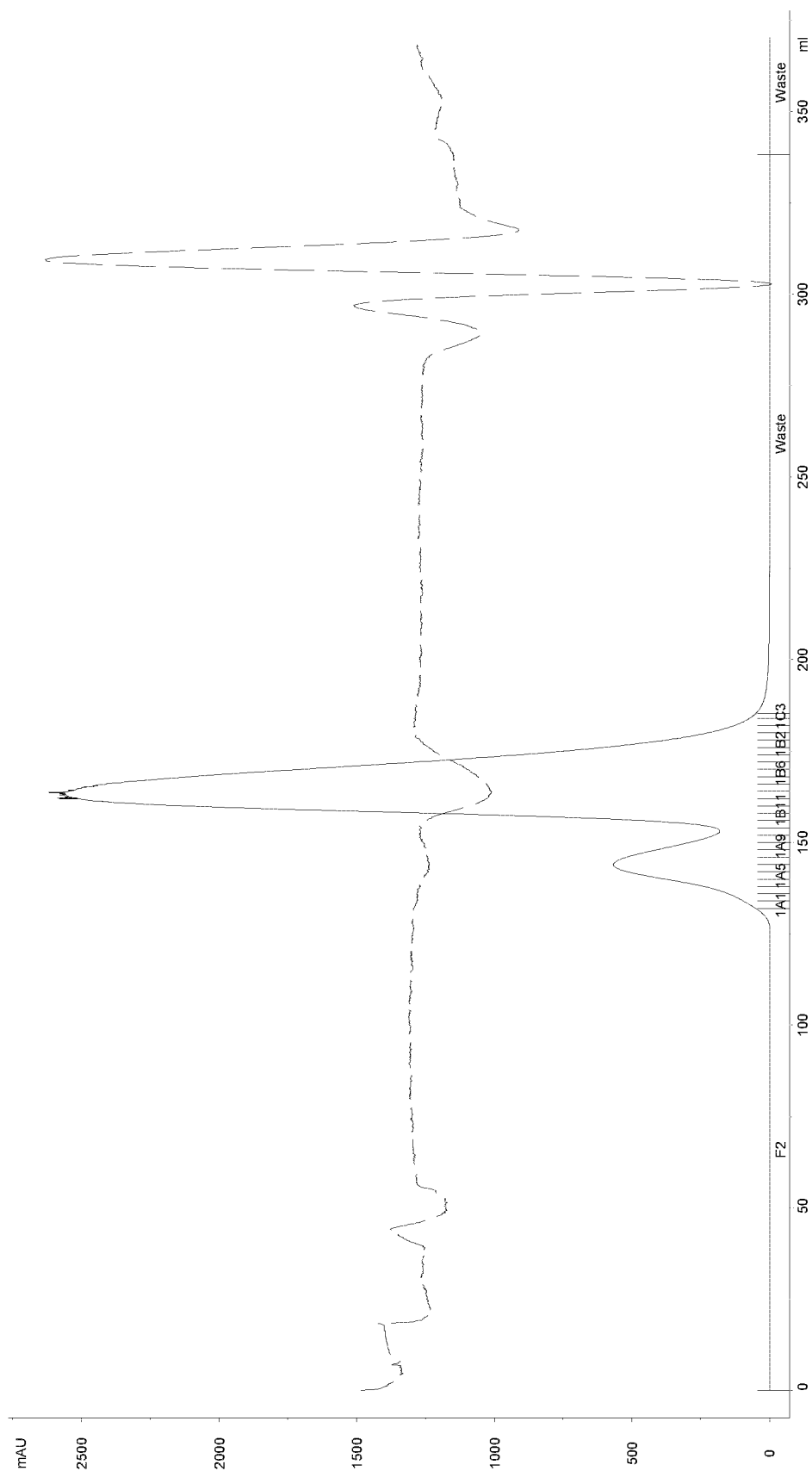
FIG. 11 concerns SP Sepharose High Performance chromatography of an anti-TL1A/anti-TNF-α IgG-scFv. It shows a representative FPLC Superdex 200 purification chromatogram of an anti-TL1A/anti-TNF-α IgG-scFv. Protein was eluted with isocratic gradient of buffer and pooled based on the A280 elution profile (black trace) and SE-HPLC analysis of fractions.
Figure 12:
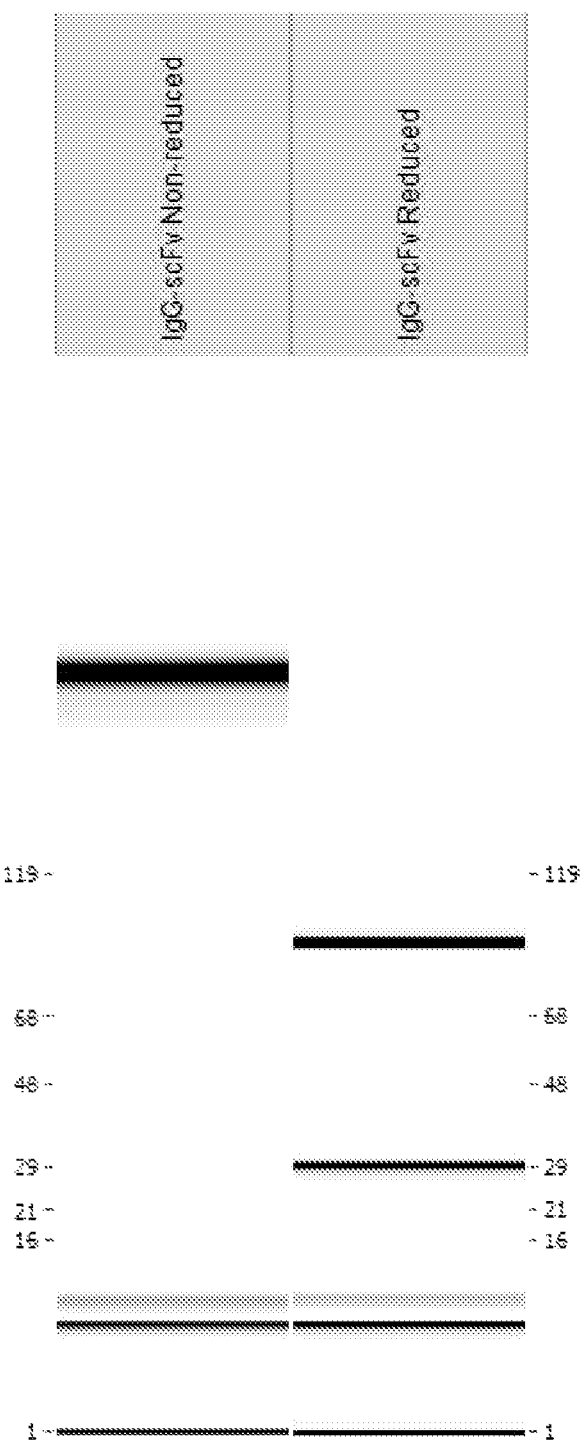
FIG. 12 shows non-reduced and reduced Caliper analysis of an anti-TL1A/anti-TNF-α IgG-scFv.
Figure 13:
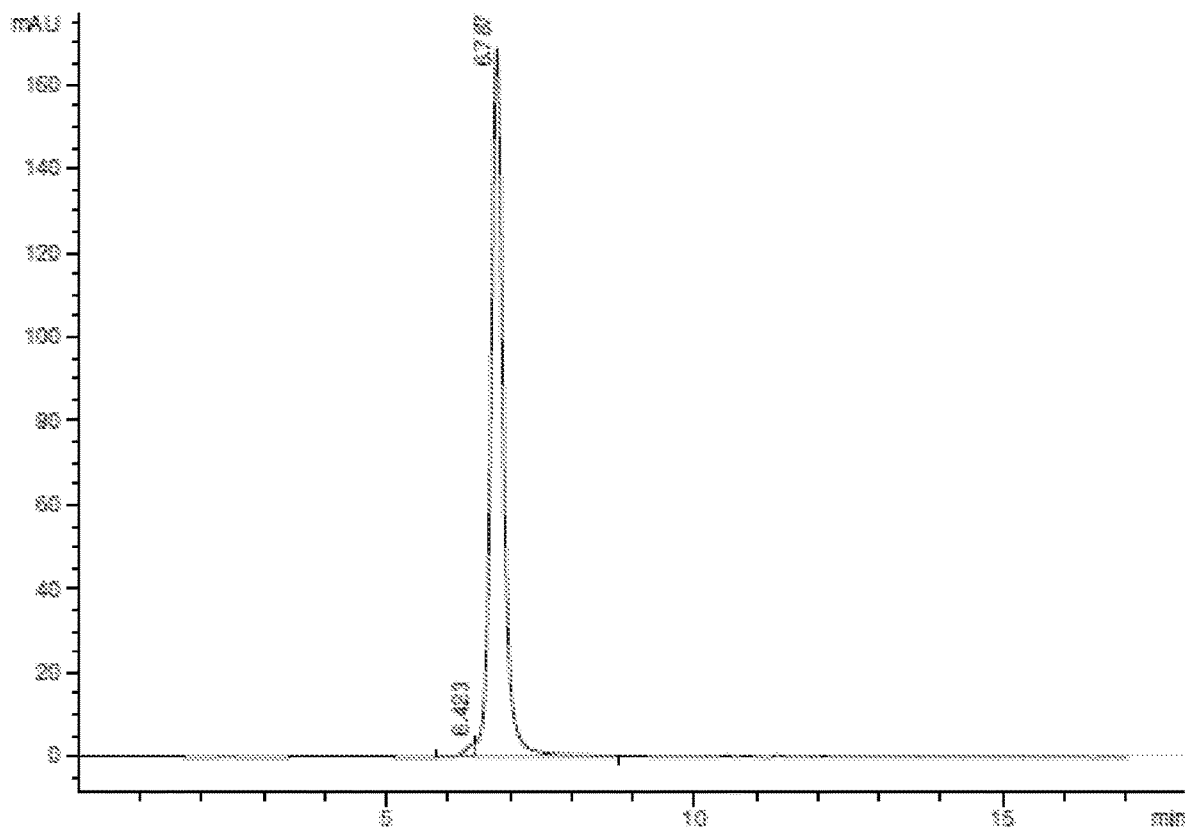
FIG. 13 concerns SE-HPLC analysis of an anti-TL1A/anti-TNF-α IgG-scFv. It shows size exclusion chromatography on 30 μg of the final anti-TL1A/anti-TNF-α IgG-scFv product injected onto a Sepax Zenix-C SEC-300 column (7.8×300 mm) in 50 mM $NaH_2PO_4$, 250 mM NaCl, pH 6.9 at 1 ml/min, observing the absorbance at 280 nm.

The IgG-scFv molecules were affinity captured by MabSelect SuRe chromatography (GE Life Sciences, Piscataway, N.J.), using Dulbecco's PBS without divalent cations (Invitrogen, Carlsbad, Calif.) as the wash buffer and 100 mM acetic acid, pH 3.6 as the elution buffer (FIG. 10). Affinity separations were carried out at ambient temperature. The elution peak was pooled based on the chromatogram, neutralized to pH 7.0 using 2 M tris base, diluted with one volume 10 mM citrate, 75 mM lysine, 4% trehalose, pH 7.0, and concentrated to approximately 20 mg/mL using a Vivacell-100 centrifugal concentrator with a 30 kDa cutoff membrane (Sartorius Stedim Biotech, Goettingen, Germany). To remove high molecular weight aggregates, the sample was filtered through a 0.8/0.2-µm cellulose acetate filter then loaded on to a Superdex 200 Prep Grade column (GE Life Sciences, Piscataway, N.J.) equilibrated with 10 mM citrate, 75 mM lysine, 4% trehalose, pH 7.0 and eluted with an isocratic gradient with the same buffer (FIG. 11). Gel filtration separations were carried out at approximately 7° C. A pool was made based on the chromatogram and analytical SEC of the fractions using a Zenix-C SEC-300 column (Sepax Technologies, Newark, Del.). The pool was further concentrated using a Vivaspin-20 centrifugal concentrator with a 30 kDa cutoff membrane (Sartorius Stedim Biotech, Goettingen, Germany) and filtered through a 0.8/0.2-µm cellulose acetate filter. The concentration was determined by the absorbance at 280 nm using an extinction coefficient of approximately 341,000. Sample purity was determined by Caliper LabChip analysis under reducing (with 2% 2-mercaptoethanol) and non-reducing (with 25 mM iodoacetamide) conditions (FIG. 12). Analytical SEC was carried out using a Zenix-C SEC-300 column (Sepax Technologies, Newark, Del.) with an isocratic elution in 50 mM sodium phosphate, 250 mM NaCl, pH 6.9 over 18' (FIG. 13).

Due to the large size of the Ig-scFvs, 200 kDa or greater, accurate mass was not achievable by ESI-TOF mass analysis. In order to verify mass and assess the quality, Ig-scFv's were analyzed after digestion with IdeS protease (Promega, Madison Wis.), which cleaves just below the IgG hinge disulfides, between glycines in the sequence motif, CPPCPAPELLG/GP yielding (Fab)$_2$ and Fc with C-terminally fused scFv. The Ig-scFv's were incubated in the presence of IdeS protease using a 1:10 enzyme substrate ratio for 1 hour at 37° C. The sample was then diluted 1:1 in 0.1% TFA, and 20 µg was injected onto LC-MS.

Figure 14:
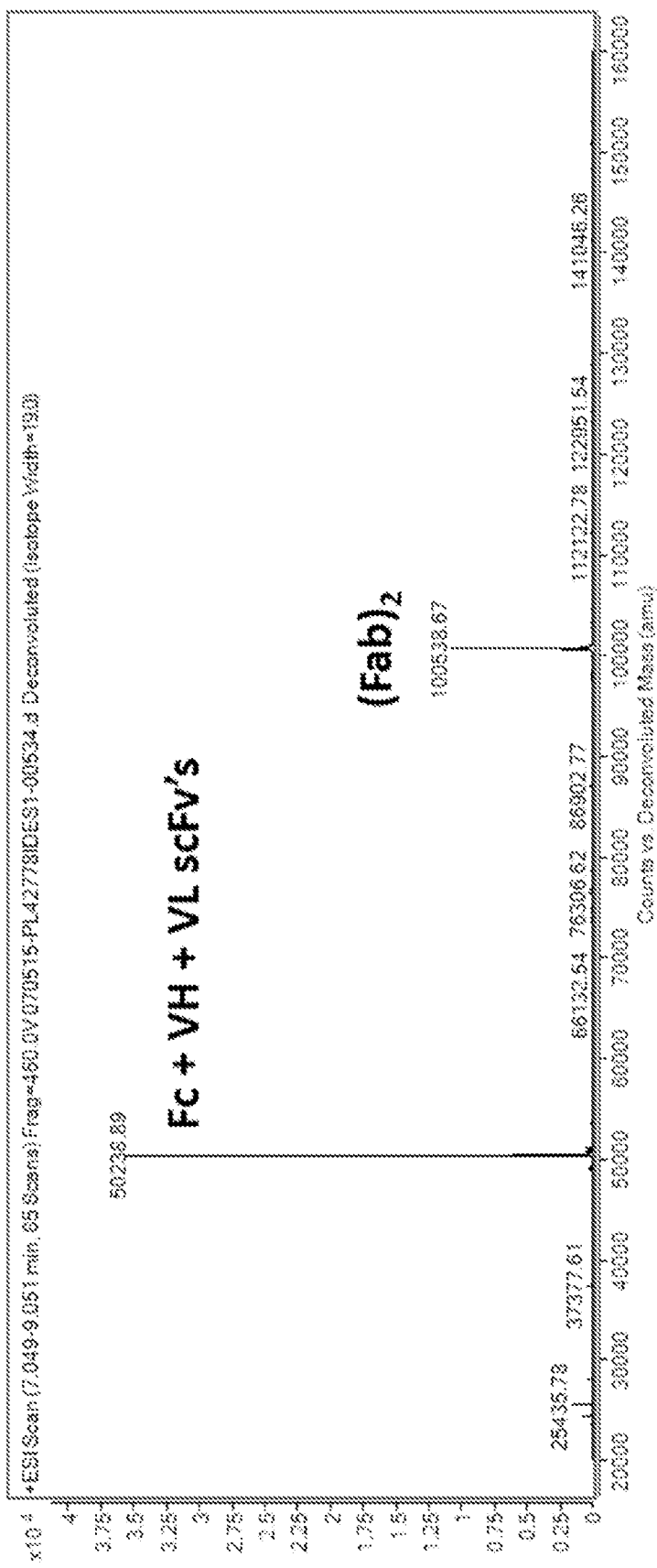
FIG. 14 concerns IdeS Protease digested Ig-scFv. It shows mass analysis of 20 μg Ig-scFv using reverse-phase HPLC separation on an Agilent Zorbax 300SB column (2.1×50 mm, 3.5 μm) with mobile phases of 0.1% TFA and 90% n-propanol/0.1% TFA (mobile phases A and B, respectively), and detection on an Agilent 6230 ESI-TOF Mass Spectrometer.
Figure 15:
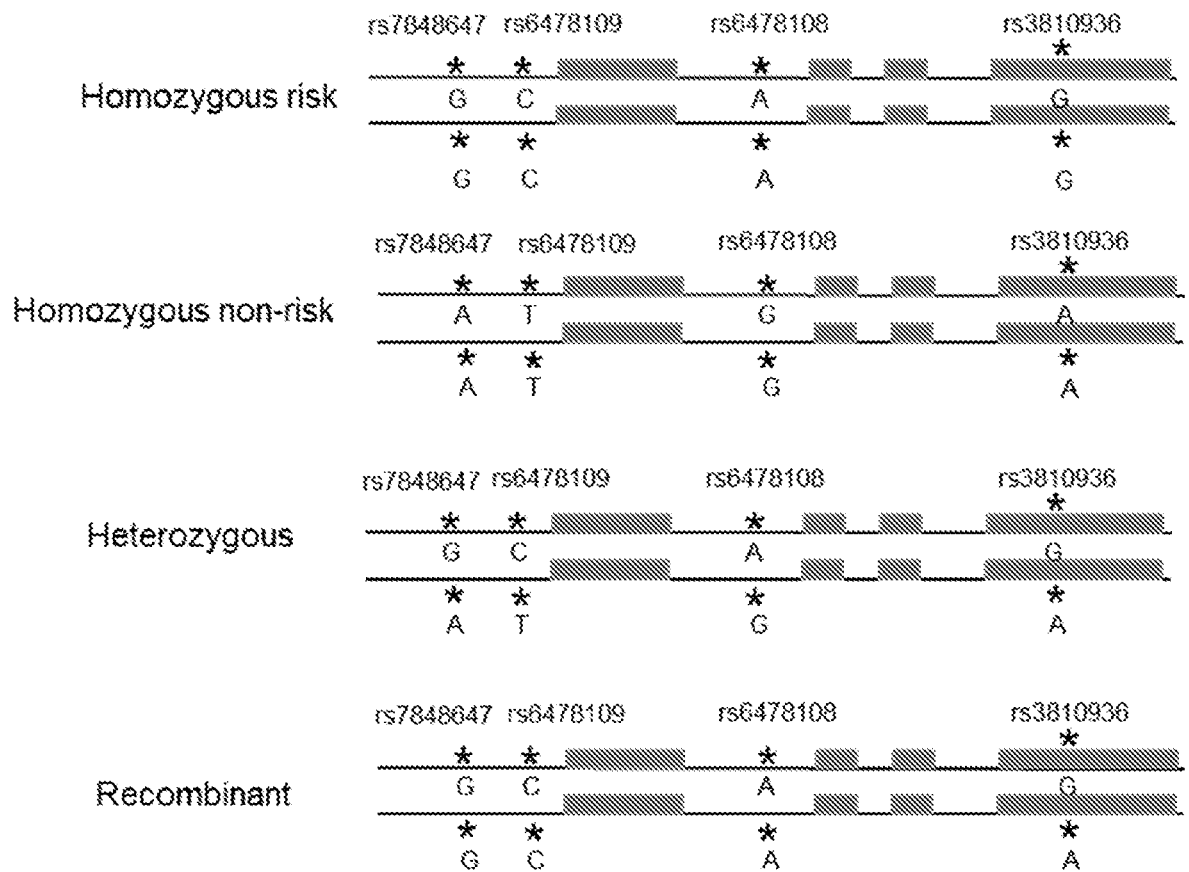
FIG. 15 shows genotyping of TL1A SNPs. To evaluate potential TL1A genotype association with expression, genomic DNA (gDNA) was isolated from healthy PBMC donors using Gentra Puregene Tissue kit from Qiagen. Genomic DNA were genotyped using TaqMan SNP genotyping assays for rs7848647, rs6478109, rs6478108, and rs3810936 assays from LifeTech and standard protocols on the Bio-Rad droplet digital PCR platform. Donors were considered homozygous risk haplotype if only risk alleles were present at all 4 genotyped SNPs (rs7848647, rs6478109, rs6478108, and rs3810936). Donors were considered homozygous non-risk haplotype if only non-risk alleles were present at all 4 genotyped SNPs. Donors were considered heterozygous haplotype if both risk and non-risk alleles were present at all 4 genotyped SNPs. Donors that were considered "recombinant" had only homozygous risk alleles at rs7848647, rs6478109, and rs6478108, but were heterozygous (risk and non-risk alleles present) at rs3810936.
Figure 16A:
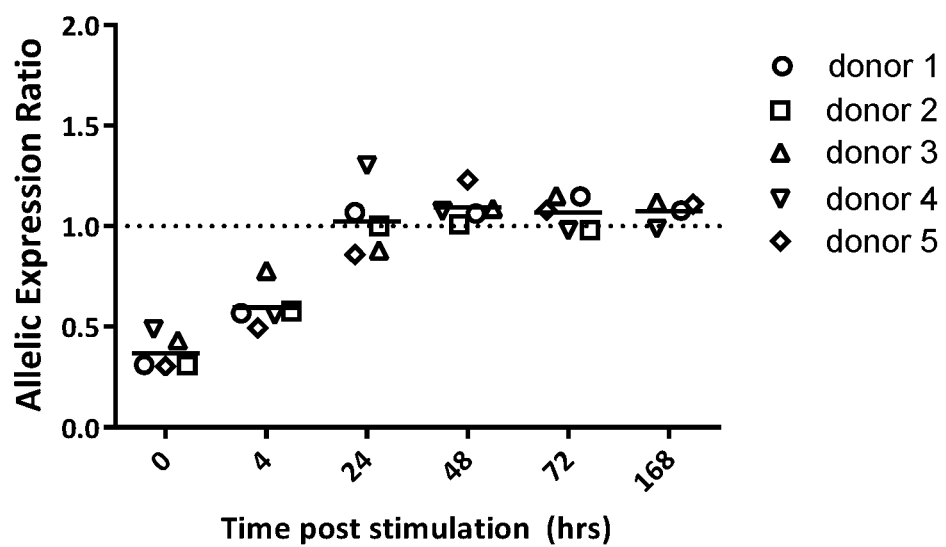
FIGS. 16A and 16B show higher fold induction of TL1A risk allele than non-risk allele in a heterozygous PBMC AEI Study. Frequency of risk vs. non-risk allele usage in heterozygous PBMC at basal level or after immune complex stimulation at various time points was examined by droplet digit PCR (ddPCR) using synonymous SNP (rs3810936) allelic specific fluorescent probes. The allelic expression ratio was calculated by dividing the copies/ml of the risk allele by the copies/ml of the non-risk allele. Total copy number of each allele was normalized by the input amount of cDNA (copies/ng), and the fold-induction for each allele at each time point was calculated by dividing the copies/ng at the time point of interest by the copies/ng at baseline (0 hr).
Figure 16B:
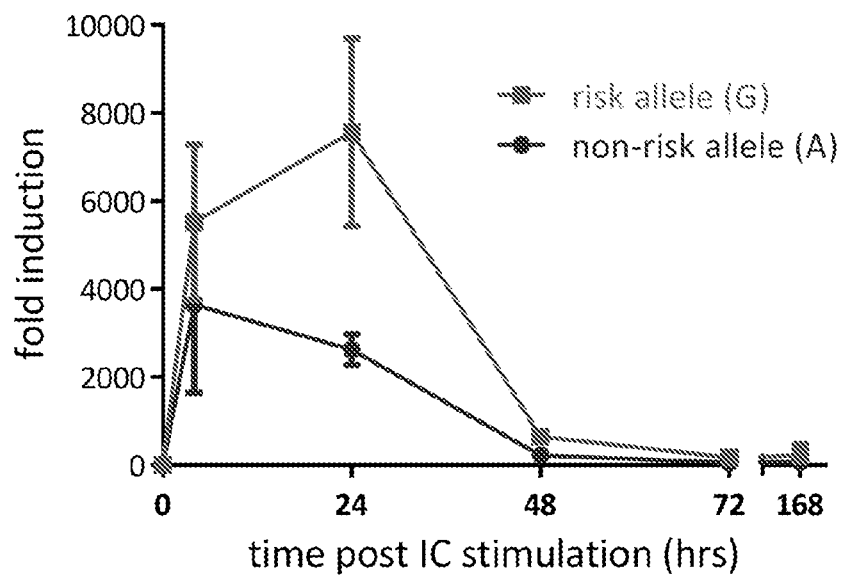
Figure 17:
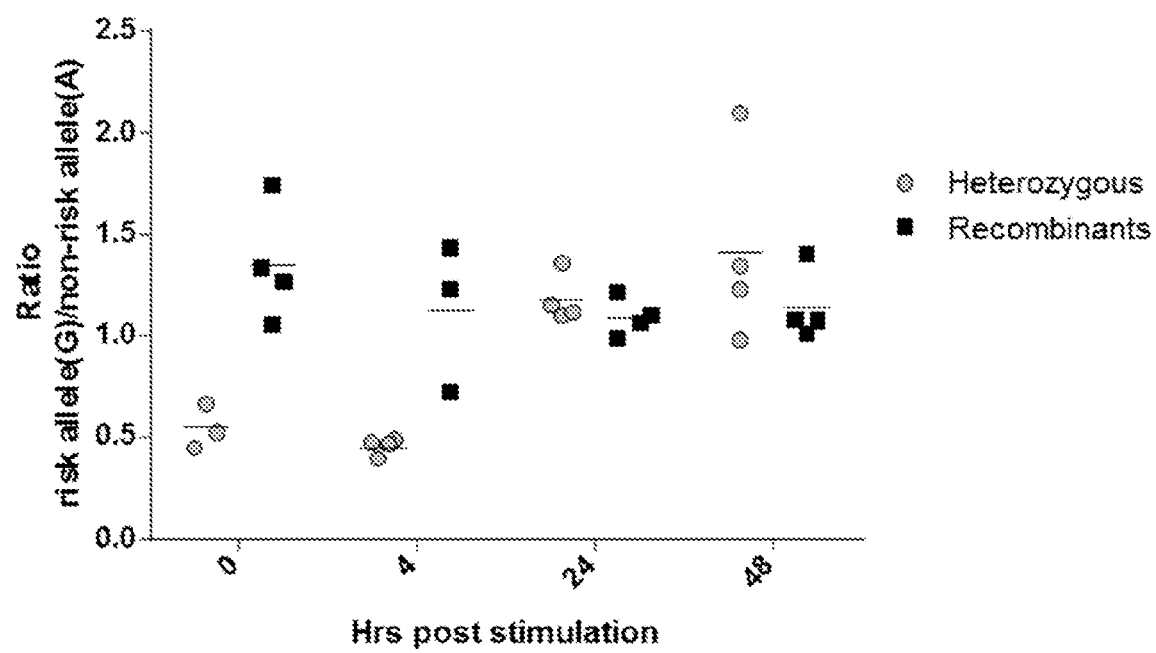
FIG. 17 shows that TL1A SNPs in promoter and intron contribute to allelic expression imbalance regulation. The inventor(s) identified a small number of donors homozygous for risk alleles at rs7848647, rs6478109, and rs6478108, but heterozygous at rs3810936, likely due to recombination between rs6478109 and synonymous SNP rs3810936. Frequency of risk vs. non-risk allele usage in heterozygous or recombinant donor PBMC was examined by droplet digit PCR (ddPCR) using synonymous SNP (rs3810936) allelic specific fluorescent probes. Compared to heterozygous donors, no allelic expression imbalance was detected in these recombinant individuals before or after immune complex stimulation.
Figure 18A:
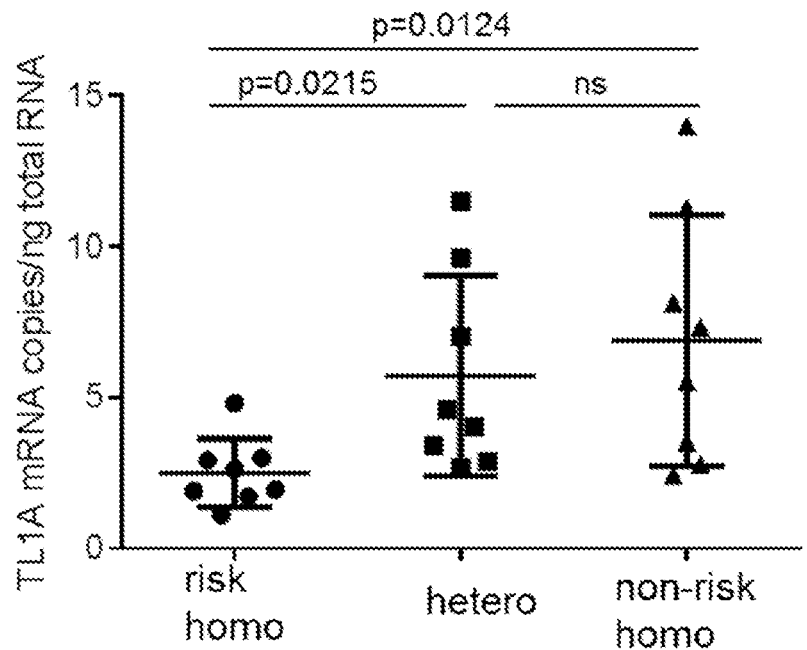
FIGS. 18A and 18B show that TL1A risk SNPs are associated with expression quantitative trait loci (eQTL), PBMC donors with homozygous TL1A risk allele, homozygous non-risk alleles or heterozygous alleles were treated with immune complex. Total expression of TL1A (TNFSF15) in each donor was determined by digital PCR. In brief, cDNA from each sample was mixed with ddPCR™ Supermix for Probes (Bio-Rad) and PrimeTime® qPCR assay ID Hs.PT.56a.41003970. Droplets were generated for each reaction using the QX100™ droplet generator (Bio-Rad) and subjected to thermal cycling on a C1000 Touch™ thermal cycler (Bio-Rad). Following amplification, droplet fluorescence was read on a QX100™ droplet reader (Bio-Rad). Data were analyzed using QuantaSoft software (Bio-Rad) and copies/μl of TL1A was determined and normalized for the amount of input cDNA (copies/ng). P values for differences in TL1A expression levels between different TNFSF15 haplotypes were determined using the student t test. At basal level, PBMCs from donors homozygous for TL1A risk SNPs have lower TL1A mRNA compared to non-risk homozygous donors. However, after immune complex stimulation, PBMCs from donors homozygous for TL1A risk SNPs have higher TL1A expression compared to non-risk homozygous donors.
Figure 18B:
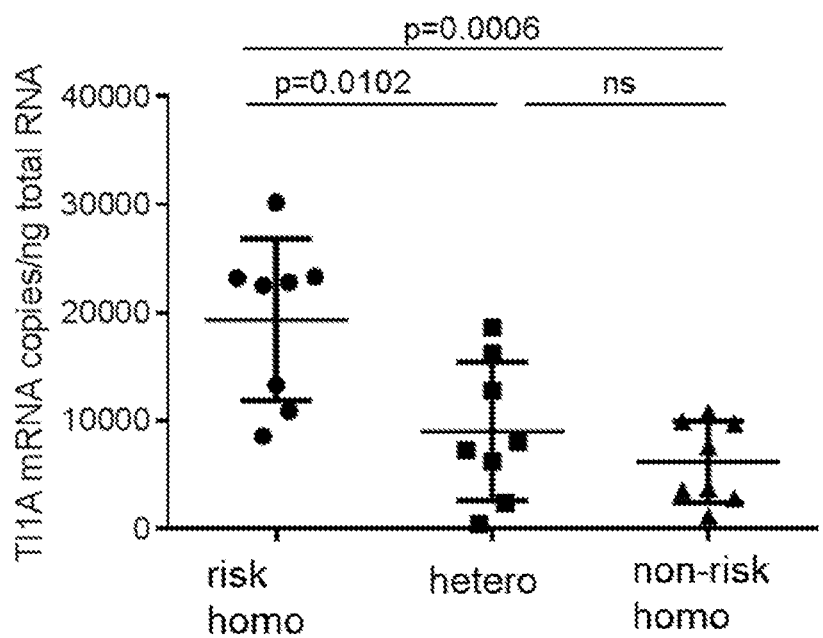
Figure 19A:
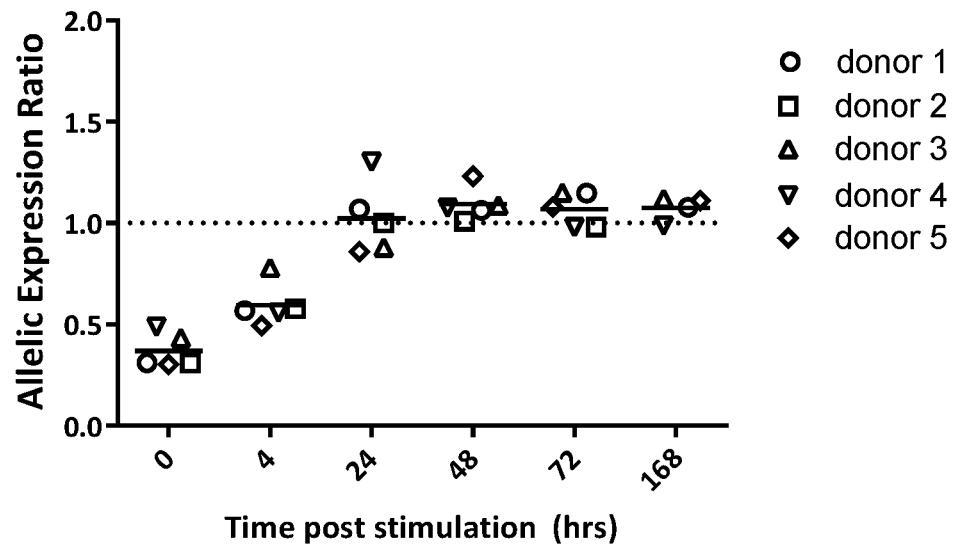
FIGS. 19A and 19B show cell-type specific regulation of TL1A synonymous SNP allelic expression imbalance. HUVEC cells from various donors were genotyped as described previously. Genotyped HUVEC cells from various donors were treated with IL-1 at various time points. Total copy number of each allele was measured as described previously. The allelic expression ratio was calculated by dividing the copies/ml of the risk allele by the copies/ml of the non-risk allele. No allelic expression imbalance was observed in HUVEC cells with or without IL-1 treatment.
Figure 19B:
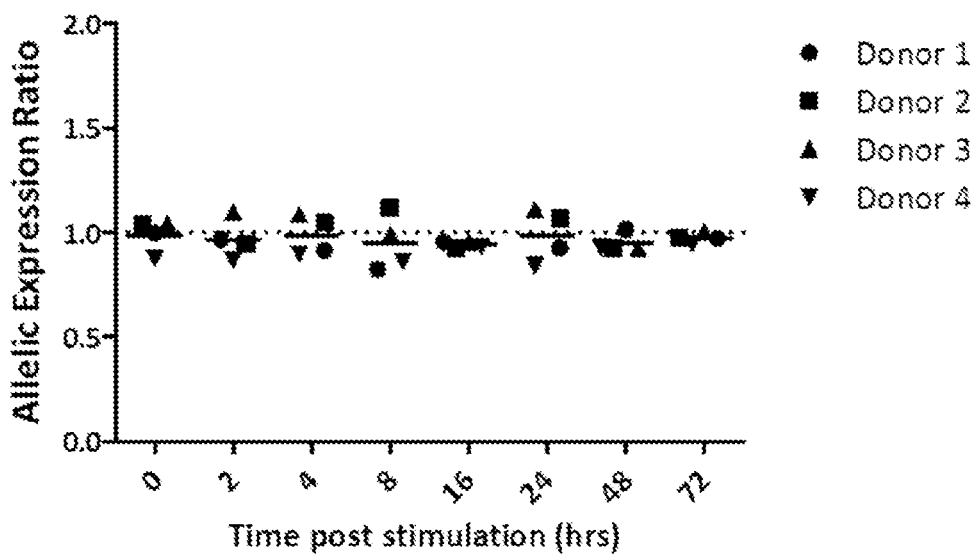
Figure 20A:
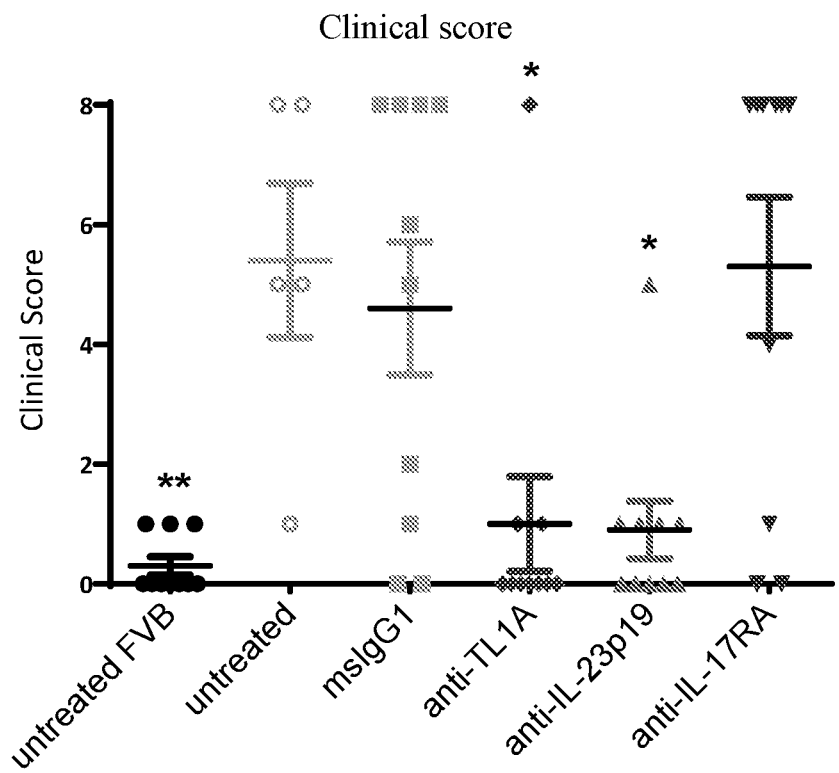
FIGS. 20A and 20B show that prophylactic treatment with anti-TL1A monoclonal antibody inhibited spontaneous colitis development in mdr1a$^{-/-}$ mice. Mice (n=10, 6-7 weeks age) were randomized to different groups and treated intra-peritoneally once a week with 500 µg of anti-mouse TL1A antibody, anti-IL23p19 antibody, anti-mouse IL17RA antibody, or mouse isotype control or no treatment once per week for 8 weeks. Clinical disease activity was monitored by evaluating anal inflammation and stool consistency. Sections of the intestine were subjected to histopath analysis. Statistical analysis was performed using one-way ANOVA with Dunett's compared to mIgG1 group.
Figure 20B:
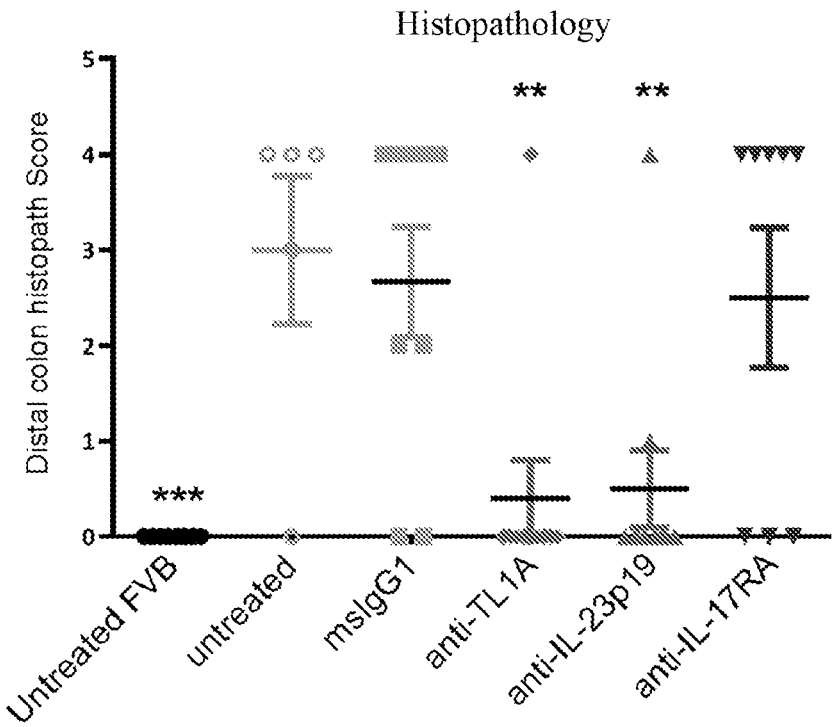
Figure 21A:
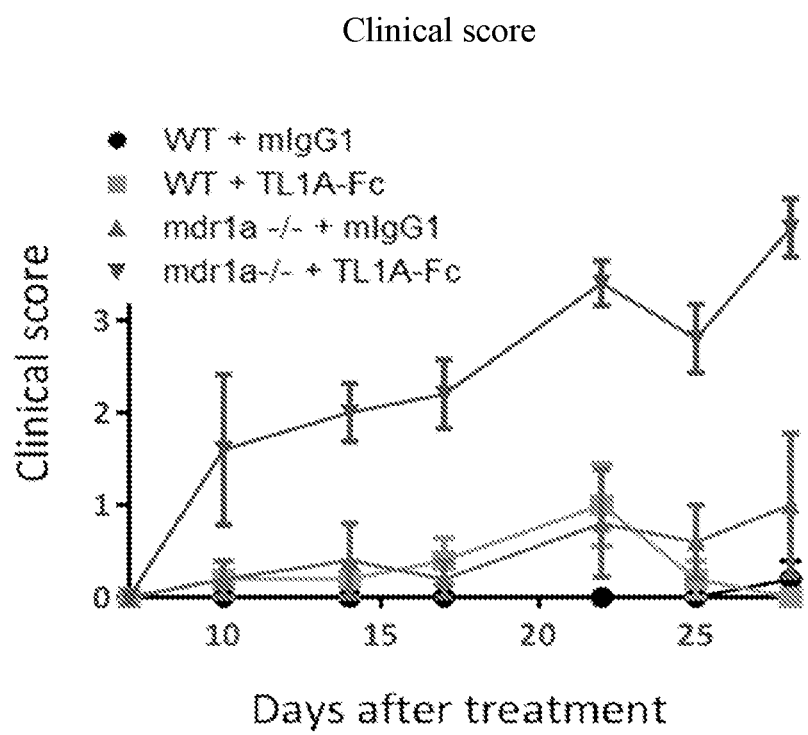
FIGS. 21A and 21B show that TL1A exacerbated colitis in mdr1a$^+$ mice. Mdr1a$^{-/-}$ mice or wild-type control mice at 6-8 weeks of age were treated intra-peritoneally once a week with 150 µg of recombinant mFc-TL1A fusion protein or isotype control three times each week for 4 weeks. Clinical disease activity was monitored by evaluating anal inflammation and stool consistency as described previously. After 4 weeks of treatment, mice were sacrificed, sections of the intestine were subjected to histopath analysis. Statistical analysis was performed using one way ANOVA with Dunett's compared to mIgG1 group.
Figure 21B:
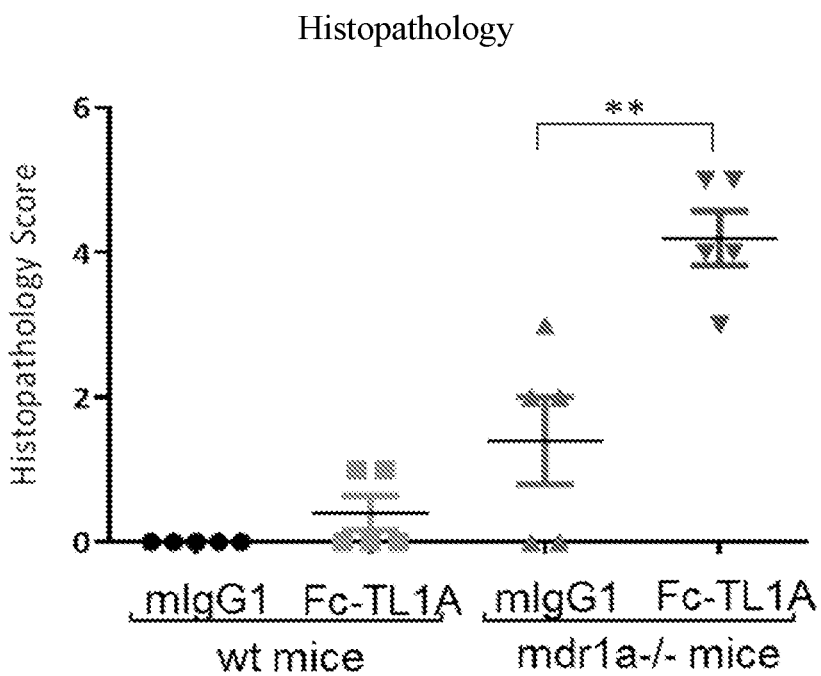
Figure 22A:
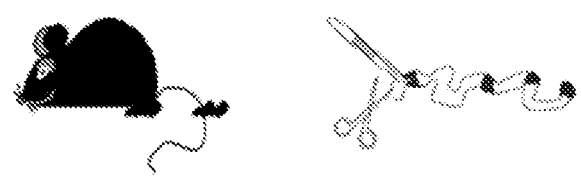
FIGS. 22A to 22F shows increased inflammatory cells in lamina propria from Fc-TL1A challenged mdr1a$^{-/-}$ mice. Mdr1a$^{-/-}$ mice or wild-type control mice at 6-8 weeks of age were treated intra-peritoneally once a week with 150 µg of recombinant mFc-TL1A fusion protein or isotype control three times each week for 4 weeks. Lamina propria lymphocytes were isolated and stained for surface antigens and analyzed by FACS. TL1A challenge in mdr1a$^{-/-}$ mice resulted in increased inflammatory cells in lamina propria.
Figure 22A:
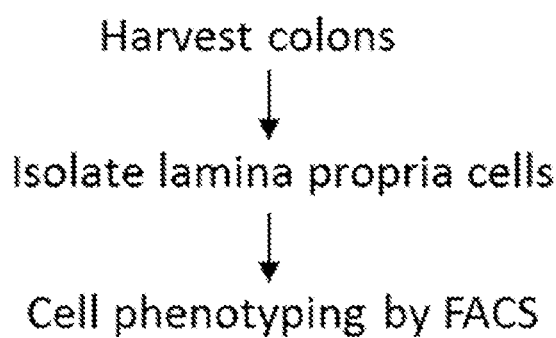
Figure 22B:
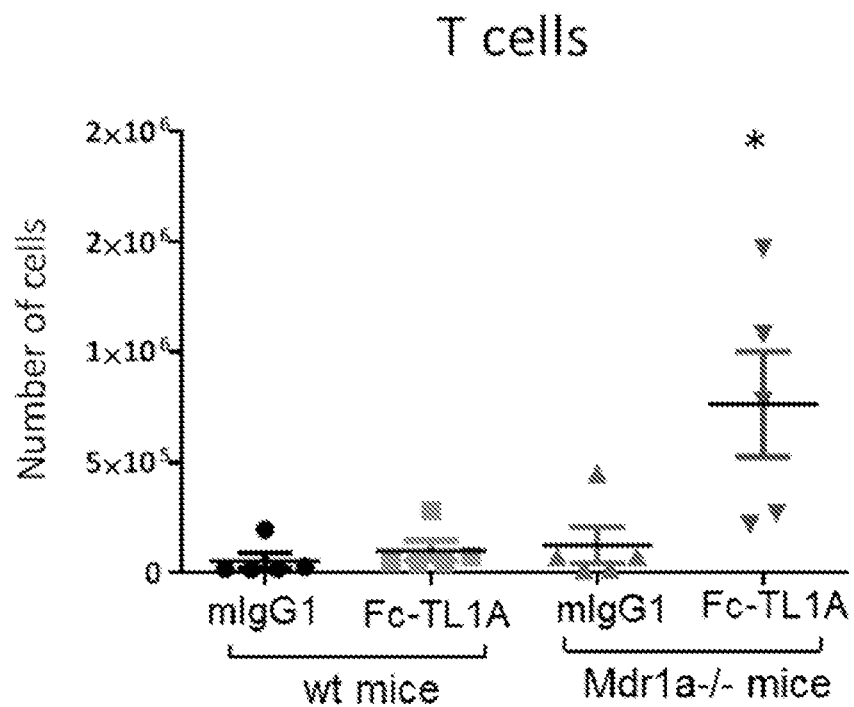
Figure 22C:
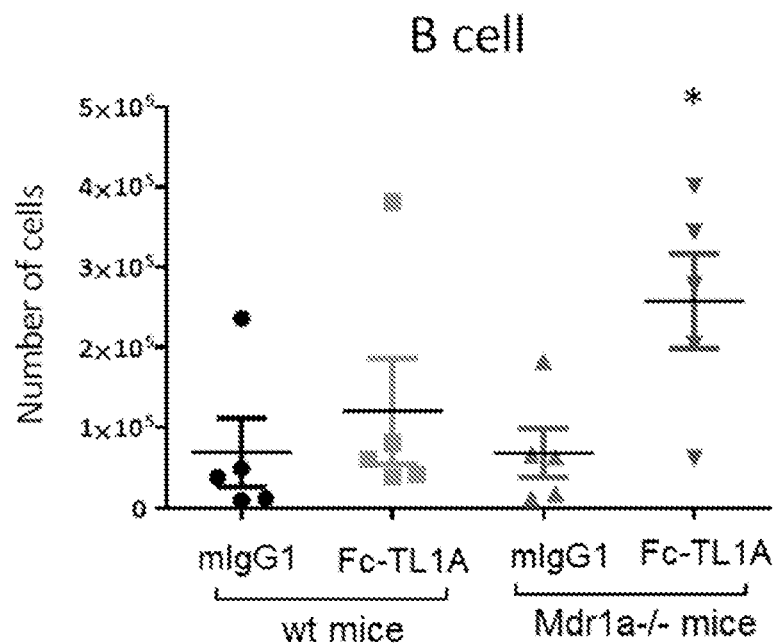
Figure 22D:
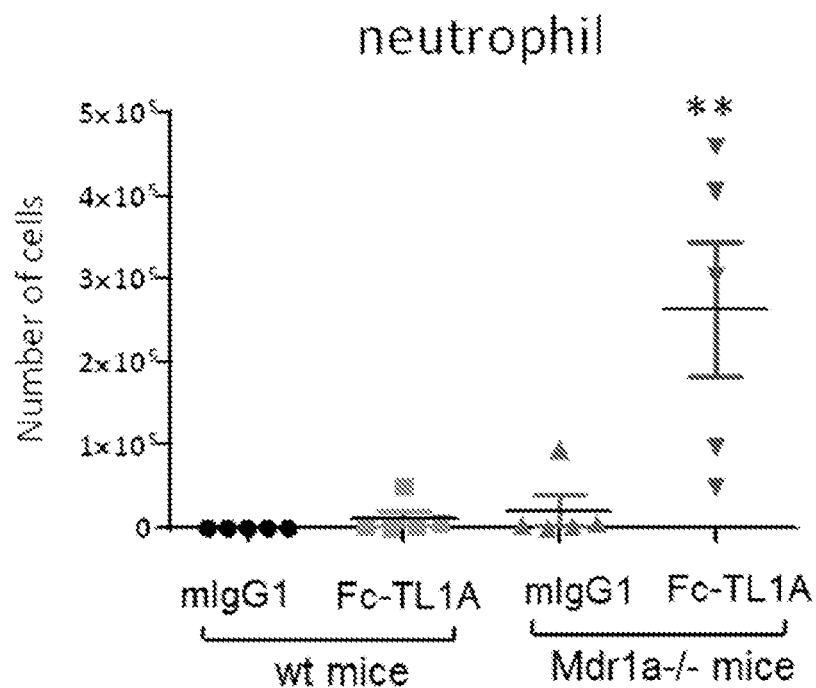
Figure 22E:
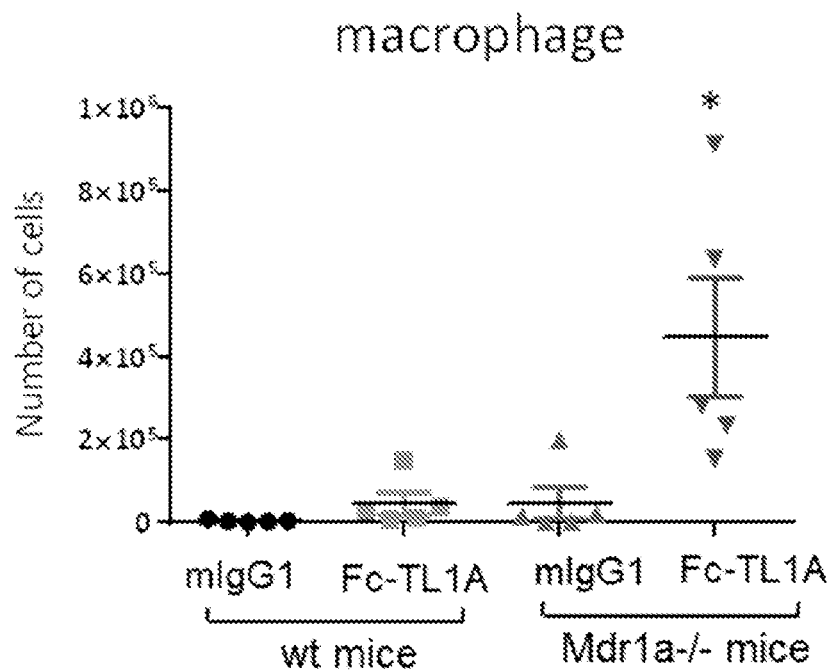
Figure 22F:
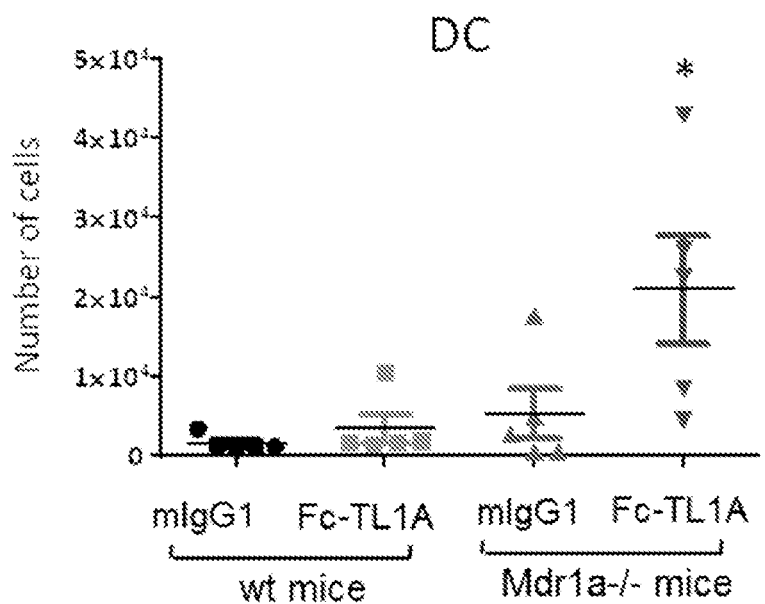
Figure 23A:
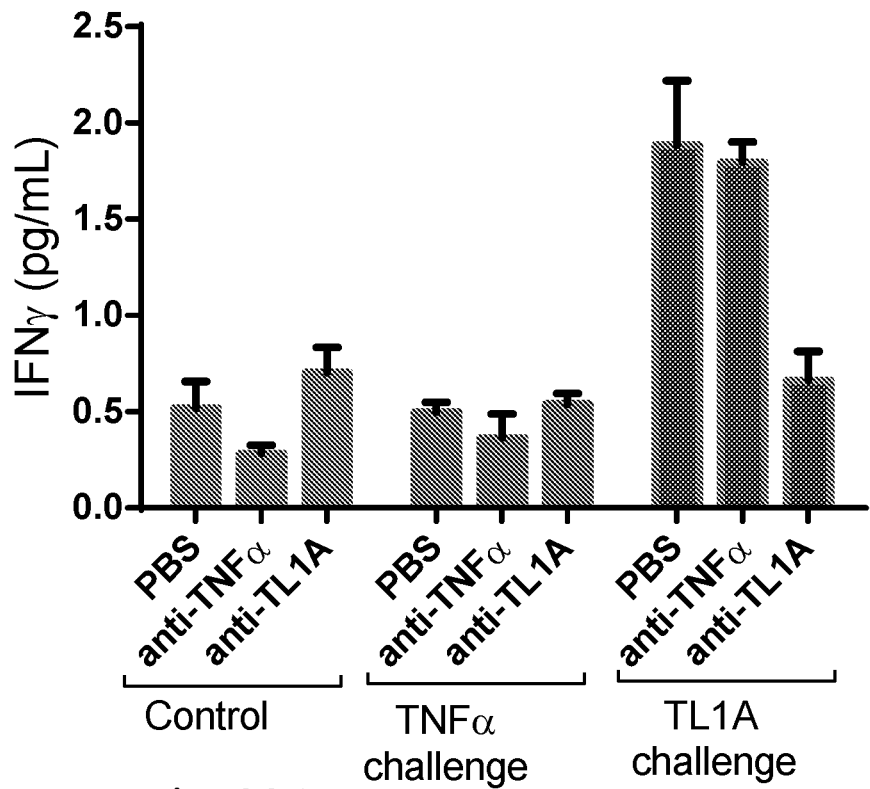
FIGS. 23A to 23E show distinct cytokine induction by TL1A and TNF challenge in mice. To evaluate if TL1A and TNF challenge result in similar or different pharmacodynamics effects, C57Bl/6 mice (8 week, female) were first intraperitonially injected with 500 µg/mice of anti mouse TL1A, anti mouse TNF-α or PBS. After 4 hours, the mice were then challenged with 100 µg/mice of TL1A or 10 µg/mice of TNF-α or without challenging. The sera were collected after 24 hours. The cytokines were measured by MSD (IL-22 was measured by ELISA).
Figure 23B:
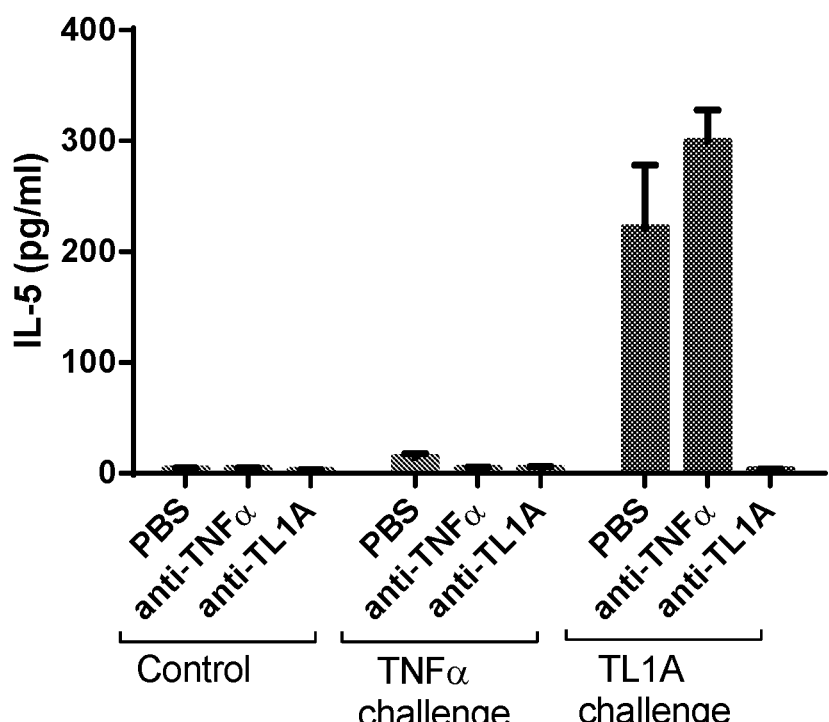
Figure 23C:
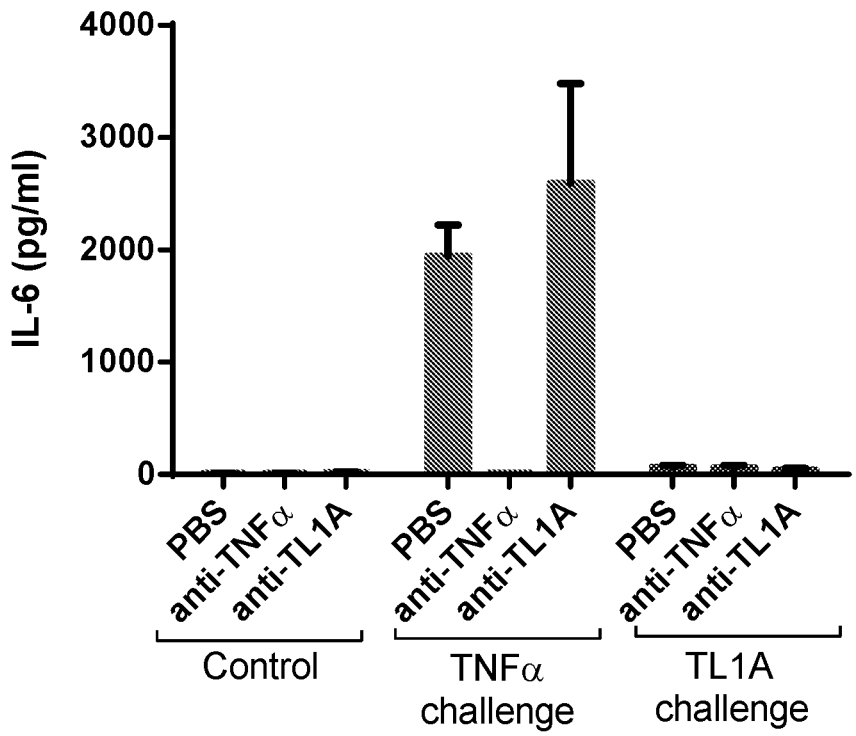
Figure 23D:
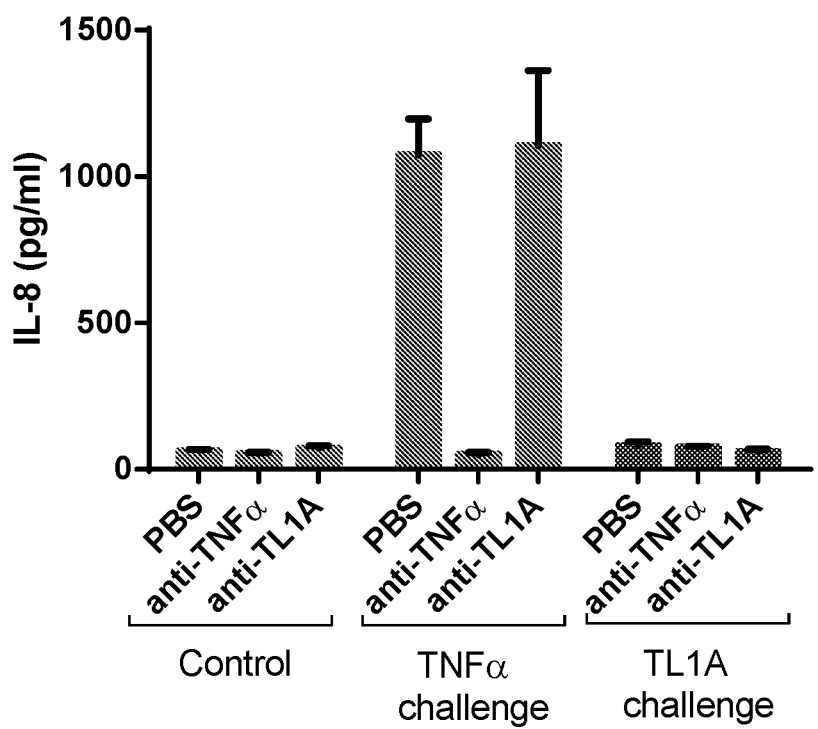
Figure 23E:
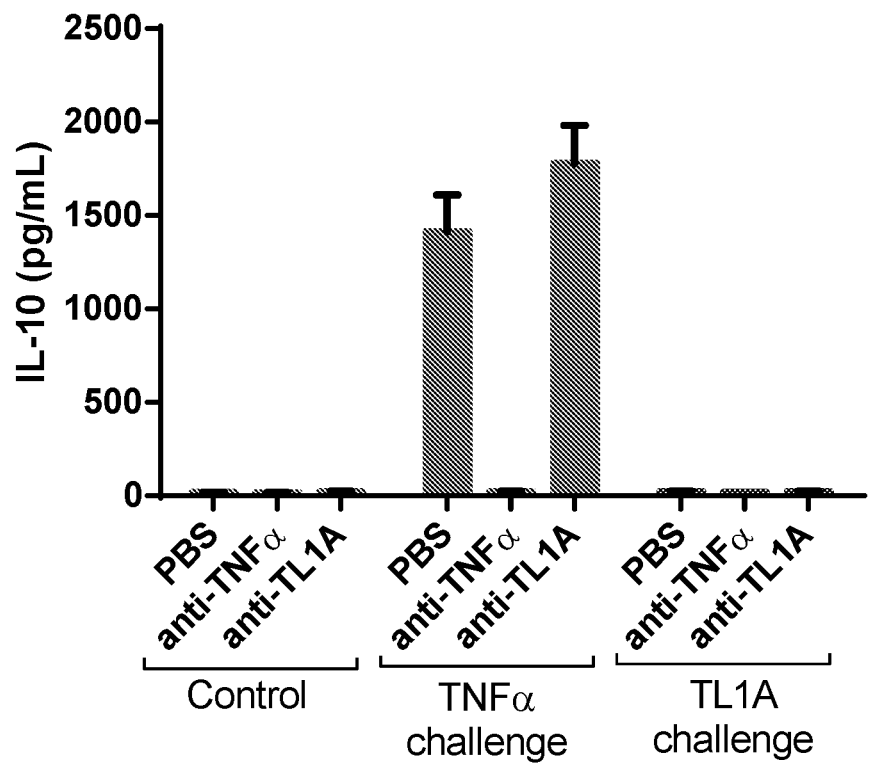
Figure 24A:
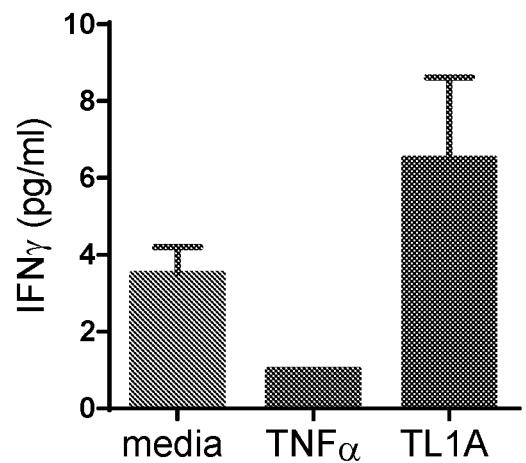
FIGS. 24A to 24F shows distinct cytokine induction by TL1A and TNF treatment in human PBMC. PBMC freshly isolated from human blood were cultured in media (RPMI1640 supplemented with 10% FBS, 2 mM glutamine, 1 mM sodium pyruvate, 5×10$^{-5}$ M 2-ME, and antibiotics) in the presence of 100 ng/ml of human TL1A or TNF-α. Supernatant was collected after 72 hours. The cytokines in the supernatant were measured by MSD (IL-22 was measured by ELISA).
Figure 24B:
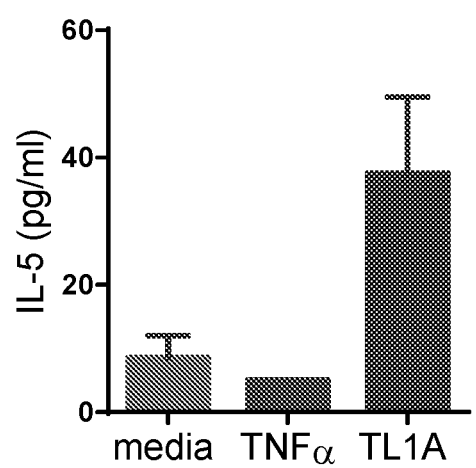
Figure 24C:
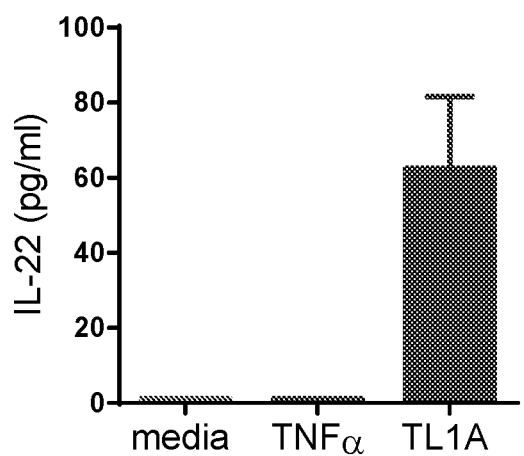
Figure 24D:
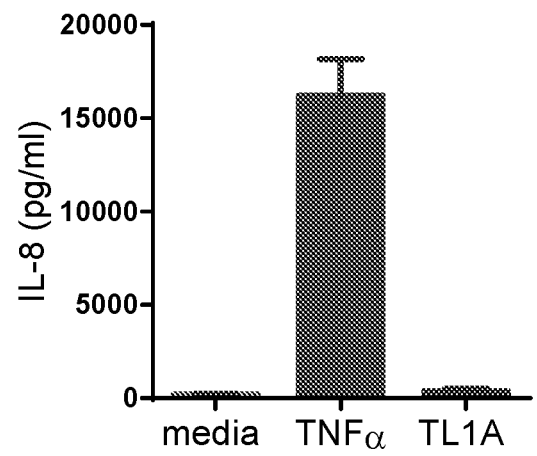
Figure 24E:
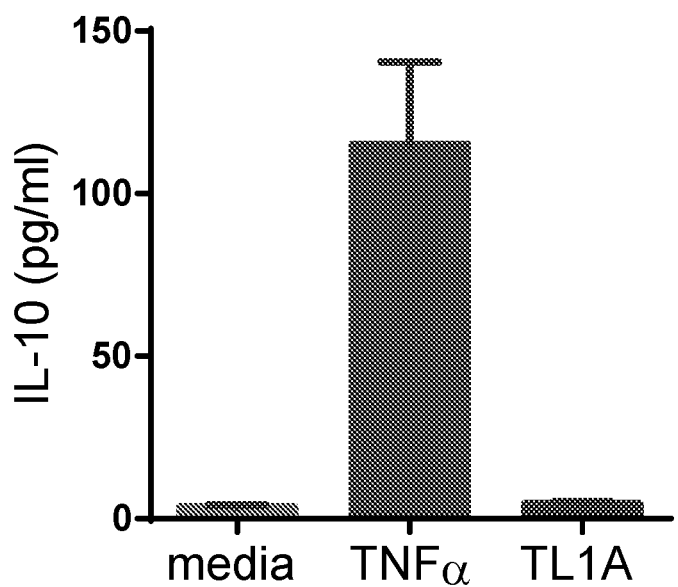
Figure 24F:
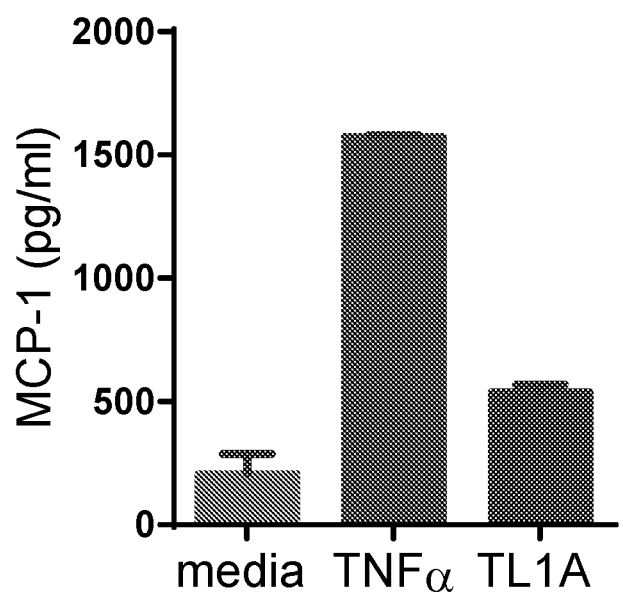

Mass analysis was performed using an Agilent 6230 ESI-TOF Mass Spectrometer and 1260 quaternary HPLC system equipped with a Zorbax 300SB-C8, 2.1×50 mm 3.5 µm column (Santa Clara, Calif.). Mobile phase A consisted of 0.1% TFA, and mobile phase B consisted of 90% n-propanol, 0.1% TFA in water. Analysis of Ig-scFv digested with IdeS Protease was conducted by injecting 20 µg and eluting using the following LC gradient: 2% mobile phase held for 2 minutes; 2-12 min, 2-45% B; 12-16 min, 45-90% B; 16-17 min 90% B. Column temperature was kept at 75° C. and post column equilibration at 20% mobile phase B was performed for 7 minutes prior to injection of the next sample (FIG. 14).

Example 13

TL1A Binding Assay

Goat anti-human Fc (Jackson Lab, Cat #109-005-098) was first immobilized on an SCM5 sensor chip using amine coupling. Anti-TL1A monoclonal antibodies, Fab fragment (using anti-huFab antibody, GE Healthcare cat #28-9583-25) or anti-TL1A/anti-TNF-α bispecific molecules were injected to the chip at 10 µl/min for 1 minute. Various concentrations of human or cynomolgus TL1A protein from 0.78 to 25 nM in sample buffer (PBS, 0.005% P20, 0.1 mg/ml BSA) were injected at flow rate of 50 µl/min for 3 min association, 10 min dissociation. On rate, off rate and equilibrium dissociation constant were calculated using 1:1 binding model on BIAevaluation software.

Tables 13.1-13.3 show anti-TL1A binding data for anti-TL1A antibodies, hetero Ig bispecific antibodies, and IgG-scFv bispecific antibodies.

TABLE 13.1

TL1A binding of anti-TL1A antibodies

| Anti-TL1A mAb | Protein ID | SEQ ID NOS: | human TL1A | | | cyno TL1A | | |
|---|---|---|---|---|---|---|---|---|
| | | | ka (1/Ms) | kd (1/s) | KD (M) | ka(1/Ms) | kd (1/s) | KD (M) |
| 3C6 | PL-39112 | 50, 52 | NA | <5.0E−05 | <1.0E−10 | 5.7E+05 | 1.4E−03 | 2.4E−09 |
| 3B3 parental | PL-39114 | 66, 68 | 4.0E+05 | 9.5E−05 | 2.4E−10 | 2.5E+05 | 1.4E−04 | 5.7E−10 |
| 5G4 | PL-39115 | 455, 457 | 5.0E+05 | 1.8E−04 | 3.6E−10 | 2.9E+05 | 1.9E−04 | 6.6E−10 |
| 17E9 | PL-39113 | 459, 461 | 2.5E+05 | 5.3E−05 | 2.2E−10 | 7.3E+05 | 2.0E−03 | 2.8E−09 |
| 9C8 | PL-39116 | 58, 60 | 1.6E+05 | 5.3E−05 | 3.4E−10 | 9.4E+04 | 6.9E−05 | 7.3E−10 |
| 23B3 | PL-36543 | 62, 64 | 4.7E+05 | 4.2E−04 | 8.9E−10 | 2.3E+05 | 3.2E−04 | 1.4E−09 |
| 2G11 | PL-36544 | 54, 56 | 1.7E+05 | 1.8E−04 | 1.1E−09 | 6.6E+04 | 4.9E−05 | 7.3E−10 |
| 3B3 variant | PL-36552 | 130, 134 | 4.3E+05 | 2.2E−04 | 5.0E−10 | 2.8E+05 | 1.4E−04 | 5.0E−10 |

TABLE 13.2

TL1A binding of anti-TL1A Fab fragment

| Anti-TL1A Fab | Protein ID | human TL1A | | | cyno TL1A | | |
|---|---|---|---|---|---|---|---|
| | | ka (1/Ms) | kd (1/s) | KD (M) | ka (1/Ms) | kd (1/s) | KD (M) |
| 3C6 | PL-39193 | NA | <5.0E−05 | <1.0E−10 | NB up to 100 nM | | |
| 3B3 parental | PL-39195 | 4.1E+05 | 1.6E−04 | 4.0E−10 | 3.5E+05 | 1.8E−04 | 5.1E−10 |
| 5G4 | PL-39196 | 4.7E+05 | 3.3E−04 | 7.0E−10 | 4.4E+05 | 1.6E−04 | 3.7E−10 |
| 17E9 | PL-39194 | NA | <5.0E−05 | <1.0E−10 | NB up to 100 nM | | |
| 9C8 | PL-39197 | NA | <5.0E−05 | <1.0E−10 | NA | <5.0E−05 | <1.0E−10 |
| 23B3 | PL-38024 | 7.6E+05 | 6.4E−04 | 8.5E−10 | 5.3E+05 | 1.6E−04 | 3.1E−10 |
| 2G11 | PL-38025 | NA | <5.0E−05 | <3.0E−10 | NA | <5.0E−05 | <1.0E−10 |
| 3B3 variant | PL-38026 | 3.8E+05 | 4.1E−04 | 1.1E−09 | 4.5E+05 | 5.6E−05 | 1.3E−10 |

TABLE 13.3

TL1A binding of hetero Ig bispecific antibodies

| iPS | anti-TNF | anti-TL1A | ka (1/Ms) | kd (1/s) | KD (M) |
|---|---|---|---|---|---|
| 376541 | Certolizumab parent | 3B3 variant (322520) | 7.1E+05 | 2.1E−04 | 3.0E−10 |
| 376542 | C234 | 3B3 variant (322520) | 7.1E+05 | 2.1E−04 | 3.0E−10 |
| 376543 | Certolizumab variant | 3B3 variant (322520) | 7.2E+05 | 2.3E−04 | 3.2E−10 |
| 349461 | Certolizumab Variant | 2G11 Variant | 5.4E+05 | 1.3E−04 | 2.5E−10 |
| 349463 | Certolizumab Variant | 23B3 VH4 | 6.3E+05 | 4.0E−04 | 6.4E−10 |
| 371222 | 3.2/CC | 3B3 variant (322520) | 6.6E+05 | 1.4E−04 | 2.1E−10 |

Example 14

TL1A Activity Assay

TL1A activity assay was performed using TF-1 NF-κB reporter cell line. In brief, 30 ng/ml (EC90) of human or cynomolgus monkey TL1A was incubated with $10^4$ TF-1 NF-κB reporter cells in the presence of serially diluted anti-TL1A antibodies or anti-TL1A/anti-TNF-α bispecific molecules in 96-well plate at 37° C. overnight. Each well was supplemented with 50 μl of Steady-glo Luciferase testing solution (Promega). Plate was covered and incubated while shaking for 10 minutes. Luciferase activity was analyzed by microbeta reader.

Tables 14.1-14.3 show anti-TL1A quality control (QC) and activity data for anti-TL1A antibodies, hetero Ig bispecific antibodies, IgG-scFv bispecific antibodies, and Fab's with both human and cynomolgus monkey TL1A.

TABLE 14.1 anti-TL1A activity of anti-TL1A antibodies and Fab fragments

| mAb | mAb/Fab | huTL1A (0.2 nM) NF-kB IC50 nM | cyno TL1A (2 nM) NF-kB IC50 nM |
|---|---|---|---|
| 3C6 | mAb | 0.153 | >100 |
|  | Fab | 0.162 | >100 |
| 17E9 | mAb | 0.168 | >100 |
|  | Fab | 70.83 | >100 |
| 3B3S65A | mAb | 0.083 | 0.595 |
|  | Fab | 0.178 | 0.434 |
| 3B3/7B3 | mAb | 0.037 | 0.390 |
|  | Fab | 0.112 | 0.647 |
| 5G4 | mAb | 0.058 | 0.622 |
|  | Fab | 2.838 | 10.06 |
| 2G11 | mAb | 0.223 | 0.938 |
|  | Fab | 0.551 | 1.637 |
| 9C8 | mAb | 0.131 | 0.721 |
|  | Fab | 2.434 | 2.748 |
| 23B3 | mAb | 0.089 | 0.619 |
|  | Fab | 2.992 | 2.629 |

TABLE 14.2

QC and activity of hetero Ig bispecific antibodies

| iPS No. | TL1A | TNF-α | Final Conc. | Final Yield | SE-HPLC HMW | SE-HPLC Main | NR 1 | NR 2 | HC1 | H2 | LC1 | LC2 | Activity TL1A (pM) | Activity TNF-α (pM) |
|---|---|---|---|---|---|---|---|---|---|---|---|---|---|---|
| 376541 | Certolizumab (parent) | 3B3 (variant) | 12.05 | 295 | 0.7 | 99.3 | 72 | 28 | 42 | 58 | 51 | 49 | 187 | 51 |
| 349461 | Certolizumab (variant) | 2G11 (variant) | 10.49 | 188 | 0.7 | 99.3 | 45 | 55 | 100 | 0 | 51 | 49 | 1284 | 60 |
| 349463 | Certolizumab (variant) | 23B3 (VH4) | 10.61 | 450 | 0.6 | 99.4 | 63 | 37 | 50 | 50 | 33 | 67 | 3464 | 64 |
| 376542 | C234 | 3B3 (variant) | 9.76 | 174 | 0.0 | 100.0 | 71 | 29 | 44 | 56 | 50 | 50 | 147 | 544 |
| 376543 | Certolizumab (variant) | 3B3 (variant) | 13.60 | 320 | 0.4 | 99.6 | 75 | 25 | 43 | 57 | 51 | 49 | 158 | 107 |

TABLE 14.3

QC and activity of IgG-scFv bispecific antibodies

| iPS | IgG | scFv | Final Conc. | Final Yield | SE-HPLC HMW | SE-HPLC Main | SE-HPLC Shoulder | NR 1 | NR 2 | HC1 | LC1 | Activity TL1A (pM) | Activity TNF-α (pM) |
|---|---|---|---|---|---|---|---|---|---|---|---|---|---|
| 371213 | TNF-α (adalimumab) | TL1A (3B3 Var2) | 12.40 | 310 | .05 | 98.3 | 1.4 | 11 | 89 | 81 | 19 | 61 | 64 |
| 371217 | TNF-α (C234) | TL1A (3B3 Var2/CC) | 13.06 | 290 | 0.4 | 98.5 | 1.2 | 39 | 61 | 81 | 18 | 69 | 40 |
| 369989 | TNF-α (adalimumab) | TL1A (9C8) | 13.83 | 199 | 0.3 | 98.1 | 1.1 | 27 | 73 | 76 | 18 | 140 | 59 |
| 369995 | TNF-α (3.2) | TL1A (9C8) | 15.81 | 217 | 1.0 | 97.9 | 1.6 |  | 100 | 80 | 17 | 199 | 53 |

TABLE 14.3-continued

QC and activity of IgG-scFv bispecific antibodies

| iPS | IgG | scFv | Final Conc. | Final Yield | SE-HPLC HMW | Main | Shoulder | Caliper NR 1 | NR 2 | HC1 | LC1 | Activity TL1A (pM) | TNF-α (pM) |
|---|---|---|---|---|---|---|---|---|---|---|---|---|---|
| 370001 | TNF-α (C234) | TL1A (9C8) | 12.41 | 289 | 0.2 | 98.2 | 1.1 | 42 | 58 | 84 | 16 | 119 | 52 |
| 369992 | TNF-α (adalimumab) | TL1A (9C8/CC) | 11.48 | 169 | 0.3 | 98.2 | 1.6 | 16 | 84 | 84 | 16 | 151 | 72 |
| 370004 | TNF-α (C234) | TL1A (9C8/CC) | 11.34 | 111 | 0.3 | 98.2 | 1.5 | 45 | 55 | 84 | 16 | 163 | 70 |
| 370013 | TL1A (9C8) | TNF-α (3.2) | 16.53 | 464 | 0.3 | 98.3 | 1.5 | 41 | 59 | 79 | 18 | 171 | 25 |
| 371219 | TL1A (3B3 Var2) | TNF-α (3.2) | 10.9 | 197 | 0.4 | 98.1 | 1.4 | 100 |  | 70 | 20 | 53 | 22 |
| 371222 | TL1A (3B3 Var2) | TNF-α (3.2/CC) | 20.07 | 157 | 0.2 | 98.3 | 1.5 | 100 |  | 78 | 18 | 86 | 26 |
| 370018 | TL1A (23B3) | TNF-α (adalimumab) | 11.59 | 112 | 2.2 | 96.5 | 1.5 | 100 |  | 86 | 14 | 157 | 25 |
| 370021 | TL1A (23B3) | TNF-α (adalimumab/CC) | 15.29 | 321 | 0.0 | 100.0 | 1.3 | 7 | 93 | 86 | 14 | 139 | 24 |

Example 15

TNF-α Binding Assay

Goat anti-human Fc was first immobilized on SCM5 sensor chip using amine coupling. Anti-TNF monoclonal antibodies, Fab fragment or TL1A/TNF bispecifics were injected to the chip at 10 μl/min for 1 min. Various concentration of human or cynomologus TNF protein from 0.78 to 25 nM in sample buffer (PBS, 0.005% P20, 0.1 mg/ml BSA) were injected at flow rate of 50 μl/min for 3 min association, 10 min dissociation. On rate, off rate and equilibrium dissociation constant were calculated using 1:1 binding model on BIAevaluation software.

Tables 15.1-15.3 show TNF-α binding activity data for anti-TNF-α antibodies, hetero Ig bispecific antibodies, IgG-scFv bispecific antibodies, and IgG-Fab bispecific antibodies.

TABLE 15.1

TNF-α binding activity of anti-TNF-α antibodies and Fab fragment

|  |  | Human TNF-α | | | Cyno TNF-α | | |
|---|---|---|---|---|---|---|---|
|  |  | $k_a$ (1/Ms) | $k_d$ (1/s) | KD (M) | $k_a$ (1/Ms) | $k_d$ (1/s) | KD(M) |
| 3.2 | mAb | 1.5E+06 | 7.3E−05 | 4.8E−11 | 9.0E+05 | 9.9E−05 | 1.1E−10 |
|  | Fab |  | <5.0E−5 |  |  | <5.0E−5 |  |
| 4.14 | mAb | 5.3E+05 | 6.1E−05 | 1.2E−10 | 3.5E+05 | 1.0E−04 | 2.9E−10 |
|  | Fab |  | <5.0E−5 |  |  | <5.0E−5 |  |
| 234 | mAb | 1.5E+06 | 7.9E−05 | 5.2E−11 | 1.2E+06 | 1.0E−04 | 8.7E−11 |
|  | Fab |  | <5.0E−5 |  |  | <5.0E−5 |  |
| Adalimumab | mAb | 7.1E+05 | 6.1E−05 | 8.6E−11 | 6.4E+05 | 5.5E−05 | 8.7E−11 |
|  | Fab | 4.5E+05 | 1.4E−04 | 3.2E−10 | 3.6E+05 | 8.1E−05 | 2.3E−10 |
| Certolizumab pegol | Peg-Fab | 3.9E+06 | 6.2E−05 | 1.6E−11 | 6.4E+06 | 2.2E−03 | 3.5E−10 |

TABLE 15.2

TNF-α binding activity of hetero Ig bispecific antibodies

| iPS | Lot | anti-TNF-α | anti-TL1A | ka (1/Ms) | kd (1/s) | KD (M) |
|---|---|---|---|---|---|---|
| 376541 | PL-42786 | Certolizumab parent | 3B3 variant (322520) | 3.2E+06 | 4.4E−05* | 1.4E−11 |
| 376542 | PL-42789 | C234 | 3B3 variant (322520) | 2.3E+06 | 1.1E−04 | 4.8E−11 |
| 376543 | PL-42790 | Certolizumab variant | 3B3 variant (322520) | 3.6E+06 | 5.5E−05 | 1.6E−11 |
| 349461 | PL-42787 | Certolizumab variant | 2G11 Variant | 3.4E+06 | 6.4E−05 | 1.9E−11 |
| 349463 | PL-42788 | Certolizumab variant | 23B3 VH4 variant | 3.4E+06 | 5.5E−05 | 1.6E−11 |

TABLE 15.3

TNF-α binding activity of IgG-scFv bispecific antibodies

| iPS | Lot | IgG | scFV | ka (1/Ms) | kd (1/s) | KD (M) |
|---|---|---|---|---|---|---|
| 369989 | PL-42765 | TNF-α (Adalimumab) | TL1A (9C8) | 1.2E+06 | 7.6E−05 | 6.6E−11 |
| 369992 | PL-42770 | TNF-α (Adalimumab) | TL1A (9C8/CC) | 1.2E+06 | 8.4E−05 | 7.3E−11 |
| 369995 | PL-42779 | TNF-α (3.2) | TL1A (9C8) | 1.7E+06 | 7.7E−05 | 4.4E−11 |
| 370001 | PL-42767 | TNF-α (C234) | TL1A (9C8) | 1.7E+06 | 9.9E−05 | 5.9E−11 |
| 370004 | PL-42785 | TNF-α (C234) | TL1A (9C8/CC) | 1.7E+06 | 1.0E−04 | 5.9E−11 |
| 370013 | PL-42781 | TL1A (9C8) | TNF-α (3.2) | 1.3E+06 | 8.8E−05 | 6.5E−11 |
| 370018 | PL-42763 | TL1A (23B3) | TNF-α (Adalimumab) | 1.1E+06 | 5.3E−05 | 5.0E−11 |
| 370021 | PL-42778 | TL1A (23B3) | TNF-α (Adalimumab/CC) | 1.1E+06 | 4.9E−05* | 4.5E−11 |
| 371213 | PL-42771 | TNF-α (Adalimumab) | TL1A (3B3.322520/CC) | 1.3E+06 | 8.2E−05 | 6.5E−11 |
| 371217 | PL-42782 | TNF-α (C234) | TL1A (3B3.322520/CC) | 1.9E+06 | 8.8E−05 | 4.8E−11 |
| 371219 | PL-42774 | TL1A (3B3.322520) | TNF-α (3.2) | 1.3E+06 | 5.5E−05 | 4.2E−11 |
| 371222 | PL-42783 | TL1A (3B3.322520) | TNF-α (3.2/CC) | 1.3E+06 | 6.3E−05 | 4.7E−11 |

Example 16

TNF-α Activity Assays

TNF-α activity assay was performed using TF-1 NF-kB reporter cell line. In brief, 1 ng/ml (EC90) of human or cynomolgus monkey TNF-α was incubated with $10^4$ TF-1 NF-κB reporter cells in the presence of a serially diluted anti-TNF-α antibodies or TL1A/TNF-α bispecific molecules in 96-well plate at 37° C. overnight. 50 µl of Steady-glo Luciferase testing solution (Promega) was added to each well. Plate was covered and incubated while shaking for 10 minutes. Luciferase activity was analyzed by microbeta reader.

Table 16.1 shows anti-TNF-α QC and activity data for anti-TNF antibodies. Tables 14.2 and 14.3 show anti-TNF-α binding activity for hetero Ig bispecific antigen binding proteins, and IgG-scFv bispecific antigen binding proteins, respectively.

TABLE 16.1

Anti-TNF-α activity of TNF-α antibodies and Fab fragments

| Antibody designation | Modality | Human TNF (20 pM) IC50 (pM) NFkB | Cyno TNF (20 pM) IC50 (pM) NFkB |
|---|---|---|---|
| 3.2 | mAb | 75 | 334 |
| | Fab | 367 | 2950 |
| 4.14 | mAb | 127 | 739 |
| | Fab | 526 | 3105 |
| 234 | mAb | 74 | 138 |
| | Fab | 825 | 2027 |
| adalimumab | mAb | 119 | 180 |
| | Fab | 670 | 1800 |
| certolizumab pegol | Peg-Fab | 91 | 1.38 µM |

Example 17

Bispecific Molecule Activity

The human and cynomolgus monkey TL1A and TNF-α binding activities of bispecific antigen binding proteins were determined as described in Examples 13 and 15. Data are shown in Table 17.1

TABLE 17.1 human and cyno TL1A and TNF binding activities

| leads | TL1A warhead | TNF-α warhead | iPS no. | TL1A binding (Kd pM) | | TNF binding (Kd pM) | |
|---|---|---|---|---|---|---|---|
| | | | | Hu TL1A | Cyno TL1A | Hu TNF | Cyno TNF |
| Hetero-Ig | 3B3 V2 | certolizumab | 376543 | 11 | 26 | 12 | 210 |
| IgG-scFv | 9C8/CC | adalimumab | 381505 | 120 | 150 | 21 | 33 |
| IgG-scFv | 9C8/CC | C234 | 381489 | 160 | 94 | 10 | 19 |
| IgG-scFv | 3B3 V2/CC | adalimumab | 381513 | 1.8 | 6.6 | 19 | 23 |

The human and cynomolgus monkey TL1A and TNF-α blocking activities of bispecific antigen binding proteins were determined as described in Examples 14 and 16. Data are shown in Table 17.2.

TABLE 17.2 human and cyno TL1A and TNF-α blocking activites

| leads | Anti-TL1A warhead | Anti-TNF-α warhead | iPS No. | TL1A assay IC50 pM soluble hu | TL1A assay IC50 pM mem hu | TL1A assay IC50 pM soluble cyno | TNF assay IC50 pM soluble hu | TNF assay IC50 pM mem hu | TNF assay IC50 pM soluble cyno |
|---|---|---|---|---|---|---|---|---|---|
| Hetero-Ig | 3B3 V2 | certolizumab | 376543 | 45.5 | 50.1 | 49.7 | 101.1 | 942.6 | 0.9 uM |
| IgG-scFv | 9C8/CC | adalimumab | 381505 | 52.2 | 46.5 | 45.3 | 72.9 | 719.5 | 96.4 |
| IgG-scFv | 9C8/CC | C234 | 381489 | 66.7 | 46.3 | 62.6 | 95.8 | 639.2 | 157.2 |
| IgG-scFv | 3B3 V2/CC | adalimumab | 381513 | 35.6 | 19.2 | 23.7 | 69.7 | 906.3 | 91.3 |

Example 18

SNP Genotyping

To evaluate potential TL1A genotype association with expression, genomic DNA (gDNA) was isolated from healthy PBMC donors using Gentra Puregene Tissue kit from Qiagen. Genomic DNA were genotyped using TaqMan SNP genotyping assays for rs7848647, rs6478109, rs6478108, and rs3810936 assays from LifeTech and standard protocols on the Bio-Rad droplet digital PCR platform. Briefly, 10 ng of gDNA from each donor was mixed with ddPCR™ Supermix for Probes (Bio-Rad) and TaqMan SNP genotyping assay (LifeTech) for each SNP of interest. Droplets were generated for each reaction using the QX100™ droplet generator (Bio-Rad) and subjected to thermal cycling on a C1000 Touch™ thermal cycler (Bio-Rad). Following amplification, droplet fluorescence was read on a QX100™ droplet reader (Bio-Rad) and data were analyzed using QuantaSoft software (Bio-Rad). Donors were considered homozygous risk haplotype if only risk alleles were present at all 4 genotyped SNPs (rs7848647, rs6478109, rs6478108, and rs3810936). Donors were considered homozygous non-risk haplotype if only non-risk alleles were present at all 4 genotyped SNPs. Donors were considered heterozygous haplotype if both risk and non-risk alleles were present at all 4 genotyped SNPs. Donors that were considered "recombinant" had only homozygous risk alleles at rs7848647, rs6478109, and rs6478108, but were heterozygous (risk and non-risk alleles present) at rs3810936.

The presence of synonymous SNP (rs3810936) in the exon 4 of the TL1A gene enabled us to track risk allele vs non-risk allele expression by droplet digit PCR (ddPCR) using allelic specific fluorescent probes in the allelic expression imbalance (AEI) study. The frequency of risk vs non-risk allele usage in heterozygous PBMC at basal level or after immune complex stimulation was evaluated at various time points. In brief, PBMCs heterozygous for TL1A genotype were treated with immune complex for various lengths of time. RNA was then isolated from PBMC using an RNeasy mini kit with on-column DNase I digestion from Qiagen. RNA from each sample was converted to cDNA using the High Capacity cDNA Reverse Transcription Kit according to manufacturer's instructions (LifeTech). Allele-specific expression at rs3810936 was determined using TaqMan SNP genotyping assay specific for rs3810936 (LifeTech) and standard protocols on the Bio-Rad droplet digital PCR platform. In brief, the amount of input cDNA was first optimized for TNFSF15 expression at each time point in order to increase precision by maximizing the number of positive droplets counted for each sample by QuantaSoft software. The optimal amount of cDNA per sample was mixed with ddPCR™ Supermix for Probes (Bio-Rad) and TaqMan SNP genotyping assay (LifeTech) for rs3810936. Droplets were generated for each reaction using the QX100™ droplet generator (Bio-Rad) and subjected to thermal cycling on a C1000 Touch thermal cycler (Bio-Rad). Following amplification, droplet fluorescence was read on a QX100™ droplet reader (Bio-Rad). Data were analyzed using QuantaSoft software (Bio-Rad) and copies/ml of each allele at rs3810936 was determined. The allelic expression ratio was calculated by dividing the copies/ml of the risk allele by the copies/ml of the non-risk allele. Total copy number of each allele was normalized by the input amount of cDNA (copies/ng), and the fold-induction for each allele at each time point was calculated by dividing the copies/ng at the time point of interest by the copies/ng at baseline (0 hr). Higher induction of TL1A risk allele was observed in PBMC after immune complex treatment compared to non-risk allele in heterozygous PBMC in allelic expression imbalance study.

The inventor(s) identified a small number of donors homozygous for risk alleles at rs7848647, rs6478109, and rs6478108, but heterozygous at rs3810936, likely due to recombination between rs6478109 and synonymous SNP rs3810936. Since these donors are heterozygous at synonymous SNP rs381093, the inventor(s) could track the risk allele and non-risk allele usage and evaluate if the allelic expression imbalance was still retained in these donors. Interestingly, compared to heterozygous donors, no allelic expression imbalance was detected in these recombinant individuals before or after immune complex stimulation. This demonstrates that synonymous SNP rs381093 itself is not responsible for allelic imbalance regulation. The regulatory SNPs likely derive from rs7848647, rs6478109, rs6478108 and/or other SNPs 5' to the synonymous SNP rs3810936.

To evaluate if TL1A allelic expression imbalance data correlate with expression quantitative trait loci (eQTL), PBMC donors with homozygous TL1A risk allele, homozygous non-risk alleles or heterozygous alleles were treated with immune complex. RNA from each sample was isolated and then converted to cDNA as described previously. Total expression of TL1A (TNFSF15) in each donor was determined by digital PCR. In brief, cDNA from each sample was mixed with ddPCR™ Supermix for Probes (Bio-Rad) and PrimeTime® qPCR assay ID Hs.PT.56a.41003970. Droplets were generated for each reaction using the QX100™ droplet generator (Bio-Rad) and subjected to thermal cycling on a C1000 Touch thermal cycler (Bio-Rad). Following amplification, droplet fluorescence was read on a QX100™ droplet reader (Bio-Rad). Data were analyzed using QuantaSoft software (Bio-Rad) and copies/μl of TL1A was determined and normalized for the amount of input cDNA (copies/ng). P values for differences in TL1A expression levels between different TNFSF15 haplotypes were determined using the student t test. TL1A is expressed at a very low basal level in PBMCs, but strongly induced after immune complex stimulation. At basal level, PBMCs from donors homozygous for TL1A risk SNPs have lower TL1A mRNA compared to non-risk homozygous donors, albeit at very low copy number, consistent with the allelic expression imbalance study which demonstrated lower ratio of risk allele versus non-risk allele without stimulation. However, after immune complex stimulation, PBMCs from donors homozygous for TL1A risk SNPs have higher TL1A expression compared to non-risk homozygous donors. These data, together, demonstrated TL1A risk SNPs regulate higher TL1A induction. The inventor(s) speculate that in inflammatory conditions such as IBD, donors carrying TL1A risk SNPs likely encounter higher TL1A induction upon encounter of stimuli such as cytokines, opsonized or non-opsonized microbes. Therefore, TL1A risk SNPs could be used for patient stratification for TL1A inhibitor or anti-TL1A/anti-TNF-α bispecific inhibitors.

To evaluate if TL1A genotype-mediated expression regulation is tissue-specific, HUVEC cells from various donors were genotyped as described previously. Genotyped HUVEC cells from various donors were treated with IL-1 at various time points. Total copy number of each allele was measured as described previously. The allelic expression ratio was calculated by dividing the copies/ml of the risk allele by the copies/ml of the non-risk allele. No allelic expression imbalance was observed in HUVEC cells with or without IL-1 treatment.

Example 19

Mouse IBD Models

To evaluate role of TL1A in IBD, a series of preclinical experiments were performed in mouse IBD models. The effect of TL1A inhibition was evaluated in mouse mdr1a−/− spontaneous colitis model. Mdr1a gene encodes multiple drug resistance gene for P-glycoprotein 170. Mice with knockout of mdr1a gene are prone to develop spontaneous colitis from 12 weeks of age due to weakened intestinal barrier. Disease course is affected by gut microbes. In our experiment, female Mdr1a$^{-/-}$ or wild type FVB controls were obtained from Taconic at 4-6 weeks of age. Animal weight and clinical disease activity was monitored regularly. The clinical disease activity score was arrived at using a summation of the scores obtained evaluating anal inflammation (0=none, 1=mild, 2=moderate, 3=severe, 4=rectal prolapse) and stool consistency (0=normal, 1=moist/sticky, 2=soft, 3=diarrhea, 4=bloody). Mice (n=10, 6-7 weeks age) were randomized to different groups based upon baseline clinical disease activity measurements, and treated intra-peritoneally once a week with 500 μg of anti-mouse TL1A antibody, anti-IL23p19 antibody, anti-mouse IL17RA antibody, or mouse isotype control or no treatment once per week for 8 weeks. Mice were then sacrificed, sections of the intestine were taken and processed for H&E staining prior to scoring for disease by a pathologist. The following score was assigned based upon the histopathology: 0=normal; 1=minimal, mononuclear infiltrate and/or epithelial hypertrophy/hyperplasia; 2=mild, mononuclear infiltrate and/or epithelial hypertrophy/hyperplasia; 3=moderate, mononuclear infiltrate and/or epithelial hypertrophy/hyperplasia with rare crypt abscesses; 4=marked, same as for 3 plus abundant crypt abscesses and crypt dropout and/or focal ulceration; 5=severe, same as for 4 but with large areas of crypt dropout and/or extensive areas of ulceration. Statistical analysis was performed using one-way ANOVA with Dunett's compared to mIgG1 group. In conclusion, prophylactic treatment with anti-TL1A mAb inhibited spontaneous colitis development in mdr1a$^{-/-}$ Mice.

The inventor(s) also evaluated if challenge with TL1A protein will exacerbate colitis development in mdr1a$^{-/-}$ mice, which are prone to develop spontaneous colitis from 12 weeks of age due to a weakened intestinal barrier. Mdr1a$^{-/-}$ mice or wild-type control mice at 6-8 weeks of age were treated intra-peritoneally once a week with 150 μg of recombinant mFc-TL1A fusion protein or isotype control three times each week for 4 weeks. Clinical disease activity was monitored by evaluating anal inflammation and stool consistency as described previously. After 4 weeks of treatment, mice were sacrificed, sections of the intestine were taken and processed for H&E staining prior to scoring for disease as described previously. Statistical analysis was performed using one-way ANOVA with Dunett's compared to mIgG1 group. Challenge of TL1A protein severely exacerbated colitis development in mdr1a$^{-/-}$ mice but not in wild-type mice.

The inventor(s) further examined the impact of TL1A challenge in lamina propria lymphocytes in mdr1a$^{-/-}$ mice versus wild-type mice. In brief, lamina propria lymphocytes were isolated as previously described (D'Souza W N et al., JI, V168:5566-5572, 2002). In brief, intestines were isolated, cut open longitudinally, rinsed with buffer and cut into 0.5 cm pieces. They were then washed twice in EDTA and the supernatants were discarded. The pieces were washed with RPMI and incubated in collagenase/DNase for 30 minutes. The isolated cells were run through a percoll gradient and the cells collected at the interphase were stained for surface antigens and analyzed by FACS. TL1A challenge in mdr1a$^{-/-}$ mice resulted in increased inflammatory cells in lamina propria.

Example 20

Pharmacodynamics Studies

To evaluate if TL1A and TNF challenges result in similar or different pharmacodynamics effects, C57Bl/6 mice (8 week, female) were first intraperitonially injected with 500 μg/mice of anti-mouse TL1A, anti-mouse TNF-α or PBS. After 4 hours, the mice were then challenged with 100 μg/mice of TL1A or 10 μg/mice of TNF-α or without challenging. The sera were collected after 24 hours. The cytokines were measured by MSD (IL-22 was measured by ELISA). Challenge with TL1A or TNF protein in mice resulted in distinct cytokine induction. TL1A challenge mainly induced IFN-γ and IL-5, whereas TNF challenge induced IL-6, IL-8 and IL-10.

The inventor(s) evaluated cytokine induction by TL1A or TNF treatment in human PBMC. In brief, PBMC freshly isolated from human blood were cultured in media (RPMI1640 supplemented with 10% FBS, 2 mM glutamine, 1 mM sodium pyruvate, $5 \times 10^{-5}$ M 2-ME, and antibiotics) in the presence of 100 ng/ml of human TL1A or TNF-α. Supernatant was collected after 72 hours. The cytokines in the supernatant were measured by MSD (IL-22 was measured by ELISA). Similar to the mice challenge experiment, treatment of TL1A with human PBMC resulted in induction of IFN-γ, IL-5 and IL-22, whereas TNF treatment resulted in increase of IL-8, IL-10 and MCP-1. Therefore, TL1A and TNF induce distinct cytokine profiles in human PBMC.

Example 21

IgG-Fab Molecules

Bispecific antigen binding proteins were prepared with a subset of the anti-TNFα and anti-TL1A antibodies. In some embodiments of this IgG-Fab format, a polypeptide comprising a VH-CH1 domain from a second antibody is fused through a peptide linker to the carboxyl-terminus of the heavy chain of a first antibody to form a modified heavy chain. A polypeptide comprising the remaining domains of the Fab fragment from the first antibody (i.e. a VL-CL domain) is co-expressed with the light chain of the first antibody and the modified heavy chain to produce the complete molecule. Assembly of the full molecule creates a tetravalent binding protein having two antigen binding domains against a first antigen located on the amino terminal side of a dimerized immunoglobulin Fc region and two antigen binding domains against a second antigen located on the carboxyl terminal side of the dimerized Fc region.

The TNFα/TL1A IgG-Fab consists of two antigen binding domains, one directed against TNFα and the other against TL1A. The DNA molecules encoding TNFα/TL1A IgG-Fab molecules contain fragments encoding an anti-TNFα (or anti-TL1A) antibody light chain, an anti-TNFα (or anti-TL1A) antibody heavy chain in which the C-terminus is fused to (i) an anti-TL1A (or anti-TNFα) antibody light chain or (ii) an anti-TL1A (or anti-TNFα) Fd (VH-CH1), and a third polypeptide comprising the other half of the Fab fragment to complete the carboxy-terminal binding domain; for example, (i) an anti-TL1A (or anti-TNFα) Fd or (ii) an anti-TL1A (or anti-TNFα) antibody light chain. The IgG-Fab bispecific molecules contain charge pair mutations introduced into CH1 and CL domains of each Fab region (Fab 1 and Fab 2 as illustrated in FIG. 3). The charge pairs are designed to allow preferential assembly of anti-TNFAR light chain/VHCH1(Fd) pair and anti-TL1A light chain/VHCH1 (Fd) pair. As an additional approach to promote correct pairing of the light chain/VHCH1 (Fd) pair, for a subset of the IgG-Fab molecules generated, the CL and CH1 regions in the carboxyl-terminal Fab (i.e. Fab 2) were swapped such that the polypeptide fused to the carboxyl-terminal region of the heavy chain of the second antibody comprised VL and CH1 regions from the first antibody and the second polypeptide comprised VH and CL regions from the first antibody. See molecules listed in Tables 21.1 and 21.3, with the VL and VH CDRs listed in Table 21.2A and 21.2B and purity listed in Table 21.4. The DNA molecules were generated by synthesized gBlocks and cloned into the pTT5.1 vector. These expression vectors were used to transfect and express the TNFα/TL1A bispecific molecules in human 293-6E cells. 144 different IgG-Fab bispecific molecules were generated. The full sequences for each molecule are set forth in Table 21.1 and the Sequence Listing.

The IgG-Fab molecules were purified using affinity captured by MabSelect SuRe chromatography (GE Life Sciences, Piscataway, N.J.) using a Large Format Autosampler (LFAS, Amgen, Inc., Thousand Oaks, Calif.). Clarified, conditioned media was loaded onto a 1 mL HiTrap MabSelect SuRe column (GE Life Sciences, Piscataway, N.J.) equilibrated with Dulbecco's phosphate buffered saline without divalent cations (D-PBS, Life Technologies, Grand Island, N.Y.). MabSelect columns were washed with 8 column volumes of D-PBS and eluted with 100 mM acetic acid, pH 3.6. When protein A eluates had an absorbance above 5 mAU at 280 nm, the eluent was directly loaded onto a HiTrap Desalting column (GE Life Sciences, Piscataway, N.J.) and developed with 1.2 column volumes of 10 mM sodium acetate, 150 mM NaCl, pH 5.0. When desalting eluates had an absorbance above 3 mAU at 280 nm, sample collection was triggered and fractions were collected in 96-well deepwell blocks to a maximum of 2 mL each. Sample purity was determined by Caliper LabChip analysis under reducing (with 2% 2-mercaptoethanol) and non-reducing (with 25 mM iodoacetamide) conditions. Analytical SEC was carried out using a Zenix-C SEC-300 column (Sepax Technologies, Newark, Del.) with an isocratic elution in 50 mM sodium phosphate, 250 mM NaCl, pH 6.9 over 8'.

The IgG-Fab molecules were tested for their expressability (titer and recovery) and activity. The results are shown in FIGS. 27 to 33 and in Table 21.3. In Table 21.3 and throughout, "ada" refers to adalimumab.

TL1A activity assay was performed using TF-1 NF-κB reporter cell line. In brief, 30 ng/ml (EC90) of human or cynomolgus monkey TL1A was incubated with $10^4$ TF-1 NF-κB reporter cells in the presence of serially diluted anti-TL1A antibodies or TL1A/TNF-α bispecific molecules in 96-well plate at 37° C. overnight. Each well was supplemented with 50 μl of Steady-glo Luciferase testing solution (Promega). Plate was covered and incubated while shaking for 10 minutes. Luciferase activity was analyzed by microbeta reader.

TNFα activity assay was performed using TF-1 NF-kB reporter cell line. In brief, 1 ng/ml (EC90) of human or cynomolgus monkey TNF-α was incubated with $10^4$ TF-1 NF-κB reporter cells in the presence of a serially diluted anti-TNF-α antibodies or TL1A/TNFα bispecific molecules in 96-well plate at 37° C. overnight. 50 μl of Steady-glo Luciferase testing solution (Promega) was added to each well. Plate was covered and incubated while shaking for 10 minutes. Luciferase activity was analyzed by microbeta reader.

TABLE 21.1 anti-TL1A anti-TNF-α IgG-Fab molecule amino acid sequences

| Molecule Designation (iPS no.) | IgG source, Fab source, aa substitutions | Light chain 1 SEQ ID NO | Light chain 2 SEQ ID NO | Heavy chain SEQ ID NO |
|---|---|---|---|---|
| 376597 | 001_Adalimumab_IgG.001_3B3v2_VH_CH1(S183E) | 1254 | 1256 | 1258 |
| 376601 | 002_Adalimumab_IgG.001_9C8_VH_CH1(S183E) | 1260 | 1262 | 1264 |
| 376605 | 003_Adalimumab_IgG.001_23B3_VH4_VH_CH1(S183E) | 1266 | 1268 | 1270 |
| 376609 | 004_3.2_IgG.001_3B3v2_VH_CH1(S183E) | 1272 | 1274 | 1276 |
| 376613 | 005_3.2_IgG.001_9C8_VH_CH1(S183E) | 1278 | 1280 | 1282 |
| 376617 | 006_3.2_IgG.001_23B3_VH4_VH_CH1(S183E) | 1284 | 1286 | 1288 |
| 376621 | 007_3B3v2_IgG.001_Adalimumab_VH_CH1(S183E) | 1290 | 1292 | 1294 |

TABLE 21.1-continued anti-TL1A anti-TNF-α IgG-Fab molecule amino acid sequences

| Molecule Designation (iPS no.) | IgG source, Fab source, aa substitutions | Light chain 1 SEQ ID NO | Light chain 2 SEQ ID NO | Heavy chain SEQ ID NO |
|---|---|---|---|---|
| 376625 | 008_3B3v2_IgG.001_3.2_VH_CH1(S183E) | 1296 | 1298 | 1300 |
| 376629 | 009_9C8_IgG.001_Adalimumab_VH_CH1(S183E) | 1302 | 1304 | 1306 |
| 376633 | 010_9C8_IgG.001_3.2_VH_CH1(S183E) | 1308 | 1310 | 1312 |
| 376637 | 011_23B3_VH4_IgG.001_Adalimumab_VH_CH1(S183E) | 1314 | 1316 | 1318 |
| 376641 | 012_23B3_VH4_IgG.001_3.2_VH_CH1(S183E) | 1320 | 1322 | 1324 |
| 376645 | 013_Adalimumab_CK(S176K)_Fc_3B3v2_VH_CH1(S183E) | 1326 | 1328 | 1330 |
| 376651 | 014_Adalimumab_CK(S176K)_Fc_9C8_VH_CH1(S183E) | 1332 | 1334 | 1336 |
| 376655 | 015_Adalimumab_CK(S176K)_Fc_23B3_VH4_VH_CH1(S183E) | 1338 | 1340 | 1342 |
| 376659 | 016_3.2_CL(S176K)_Fc_3B3v2_VH_CH1(S183E) | 1344 | 1346 | 1348 |
| 376665 | 017_3.2_CL(S176K)_Fc_9C8_VH_CH1(S183E) | 1350 | 1352 | 1354 |
| 376669 | 018_3.2_CL(S176K)_Fc_23B3_VH4_VH_CH1(S183E) | 1356 | 1358 | 1360 |
| 376673 | 019_3B3v2_CK(S176K)_Fc_Adalimumab_VH_CH1(S183E) | 1362 | 1364 | 1366 |
| 376679 | 020_3B3v2_CK(S176K)_Fc_3.2_VH_CH1(S183E) | 1368 | 1370 | 1372 |
| 376683 | 021_9C8_CK(S176K)_Fc_Adalimumab_VH_CH1(S183E) | 1374 | 1376 | 1378 |
| 376689 | 022_9C8_CK(S176K)_Fc_3.2_VH_CH1(S183E) | 1380 | 1382 | 1384 |
| 376693 | 023_23B3_VH4_CK(S176K)_Fc_Adalimumab_VH_CH1(S183E) | 1386 | 1388 | 1390 |
| 376699 | 024_23B3_VH4_CK(S176K))_Fc_ 3.2_VH_CH1(S183E) | 1392 | 1394 | 1396 |
| 376703 | 025_Adalimumab_IgG.001_3B3v2_VH_CK(S176E) NA | 1398 | 1400 | 1402 |
| 376709 | 026_Adalimumab_IgG.001_9C8_VH_CK(S176E) | 1404 | 1406 | 1408 |
| 376715 | 027_Adalimumab_IgG.001_23B3_VH4_VH_CK(S176E) | 1410 | 1412 | 1414 |
| 376721 | 028_3.2_IgG.001_3B3v2_VH_CK(S176E) | 1416 | 1418 | 1420 |
| 376725 | 029_3.2_IgG.001_9C8_VH_CK(S176E) | 1422 | 1424 | 1426 |
| 376729 | 030_3.2_IgG.001_23B3_VH4_VH_CK(S176E) | 1428 | 1430 | 1432 |
| 376733 | 031_3B3v2_IgG.001_Adalimumab_VH_CK(S176E) | 1434 | 1436 | 1438 |
| 376739 | 032_3B3v2_IgG.001_3.2_VH_CL(S176E) | 1440 | 1442 | 1444 |
| 376745 | 033_9C8_IgG.001_Adalimumab_VH_CK(S176E) | 1446 | 1448 | 1450 |
| 376750 | 034_9C8_IgG.001_3.2_VH_CL(S176E) | 1452 | 1454 | 1456 |
| 376755 | 035_23B3_VH4_IgG.001_Adalimumab_VH_CK(S176E) | 1458 | 1460 | 1462 |
| 376760 | 036_23B3_VH4_IgG.001_3.2_VH_CL(S176E) | 1464 | 1466 | 1468 |
| 376765 | 037_Adalimumab_CK(S176K)_Fc_3B3v2_VH_CK(S176E) | 1470 | 1472 | 1474 |
| 376770 | 038_Adalimumab_CK(S176K)_Fc_9C8_VH_CK(S176E) | 1476 | 1478 | 1480 |
| 376775 | 039_Adalimumab_CK(S176K)_Fc_23B3_VH4_VH_CK(S176E) | 1482 | 1484 | 1486 |
| 376779 | 040_3.2_CL(S176K)_Fc_3B3v2_VH_CK(S176E) | 1488 | 1490 | 1492 |
| 376784 | 041_3.2_CL(S176K)_Fc_9C8_VH_CK(S176E) | 1494 | 1496 | 1498 |
| 376789 | 042_3.2_CL(S176K)_Fc_23B3_VH4_VH_CK(S176E) | 1500 | 1502 | 1504 |
| 376793 | 043_3B3v2_CK(S176K)_Fc_Adalimumab_VH_CK(S176E) | 1506 | 1508 | 1510 |
| 376797 | 044_3B3v2_CK(S176K)_Fc_3.2_VH_CL(S176E) | 1512 | 1514 | 1516 |
| 376801 | 045_9C8_CK(S176K)_Fc_Adalimumab_VH_CK(S176E) | 1518 | 1520 | 1522 |
| 376806 | 046_9C8_CK(S176K)_Fc_3.2_VH_CL(S176E) | 1524 | 1526 | 1528 |
| 376811 | 047_23B3_VH4_CK(S176K)_Fc_Adalimumab_VH_CK(S176E) | 1530 | 1532 | 1534 |
| 376816 | 048_23B3_VH4_CK(S176K)_Fc_3.2_VH_CL(S176E) | 1536 | 1538 | 1540 |
| 376821 | 059_Adalimumab_IgG.002_3B3v2_VH_CH1(S183E).001 | 1542 | 1544 | 1546 |
| 376826 | 060_Adalimumab_IgG.002_9C8_VH_CH1(S183E).001 | 1548 | 1550 | 1552 |
| 376830 | 061_Adalimumab_IgG.002_23B3_VH4_VH_CH1(S183E).001 | 1554 | 1556 | 1558 |
| 376834 | 062_3.2_IgG.002_3B3v2_VH_CH1(S183E).001 | 1560 | 1562 | 1564 |
| 376868 | 063_3.2_IgG.002_9C8_VH_CH1(S183E).001 | 1566 | 1568 | 1570 |
| 376842 | 064_3.2_IgG.002_23B3_VH4_VH_CH1(S183E).001 | 1572 | 1574 | 1576 |
| 376846 | 065_3B3v2_IgG.002_Adalimumab_VH_CH1(S183E).001 | 1578 | 1580 | 1582 |
| 376850 | 066_3B3v2_IgG.002_3.2_VH_CH1(S183E).001 | 1584 | 1586 | 1588 |
| 376854 | 067_9C8_IgG.002_Adalimumab_VH_CH1(S183E).001 | 1590 | 1592 | 1594 |
| 376858 | 068_9C8_IgG.002_3.2_VH_CH1(S183E).001 | 1596 | 1598 | 1600 |
| 376862 | 069_23B3_VH4_IgG.002_Adalimumab_VH_CH1(S183E).001 | 1602 | 1604 | 1606 |
| 376867 | 070_23B3_VH4_IgG.002_3.2_VH_CH1(S183E).001 | 1608 | 1610 | 1612 |
| 376872 | 071_Adalimumab_CK(S176K)_Fc.001_3B3v2_VH_CH1(S183E).001 | 1614 | 1616 | 1618 |
| 376879 | 072_Adalimumab_CK(S176K)_Fc.001_9C8_VH_CH1(S183E).001 | 1620 | 1622 | 1624 |
| 376884 | 073_Adalimumab_CK(S176K)_Fc.001_23B3_VH4_VH_CH1(S183E).001 | 1626 | 1628 | 1630 |
| 376889 | 074_3.2_CL(S176K)_Fc.001_3B3v2_VH_CH1(S183E).001 | 1632 | 1634 | 1636 |
| 376896 | 075_3.2_CL(S176K)_Fc.001_9C8_VH_CH1(S183E).001 | 1638 | 1640 | 1642 |
| 376901 | 076_3.2_CL(S176K)_Fc.001_23B3_VH4_VH_CH1(S183E).001 | 1644 | 1646 | 1648 |
| 376906 | 077_3B3v2_CK(S176K)_Fc.001_Adalimumab_VH_CH1(S183E).001 | 1650 | 1652 | 1654 |
| 376913 | 078_3B3v2_CK(S176K)_Fc.001_0013.2_VH_CH1(S183E).001 | 1656 | 1658 | 1660 |
| 376918 | 079_9C8_CK(S176K)_Fc.001_Adalimumab_VH_CH1(S183E).001 | 1662 | 1664 | 1666 |
| 376925 | 080_9C8_CK(S176K)_Fc.001_3.2_VH_CH1(S183E).001 | 1668 | 1670 | 1672 |
| 376930 | 081_23B3_VH4_CK(S176K)_Fc.001_Adalimumab_VH_CH1(S183E).001 | 1674 | 1676 | 1678 |
| 376937 | 082_23B3_VH4_CK(S176K)_Fc.001_3.2_VH_CH1(S183E).001 | 1680 | 1682 | 1684 |
| 376941 | 083_Adalimumab_IgG.002_3B3v2_VH_CK(S176E).001 | 1686 | 1688 | 1690 |
| 376948 | 084_Adalimumab_IgG.002_9C8_VH_CK(S176E).001 | 1692 | 1694 | 1696 |
| 376955 | 085_Adalimumab_IgG.002_23B3_VH4_VH_CK(S176E).001 | 1698 | 1700 | 1702 |
| 376962 | 086_3.2_IgG.002_3B3v2_VH_CK(S176E).001 | 1704 | 1706 | 1708 |
| 376967 | 087_3.2_IgG.002_9C8_VH_CK(S176E).001 | 1710 | 1712 | 1714 |
| 376972 | 088_3.2_IgG.002_23B3_VH4_VH_CK(S176E).001 | 1716 | 1718 | 1720 |
| 376976 | 089_3B3v2_IgG.002_Adalimumab_VH_CK(S176E).001 | 1722 | 1724 | 1726 |
| 376983 | 090_3B3v2_IgG.002_3.2_VH_CL(S176E).001 | 1728 | 1730 | 1732 |
| 376990 | 091_9C8_IgG.002_Adalimumab_VH_CK(S176E).001 | 1734 | 1736 | 1738 |

TABLE 21.1-continued anti-TL1A anti-TNF-α IgG-Fab molecule amino acid sequences

| Molecule Designation (iPS no.) | IgG source, Fab source, aa substitutions | Light chain 1 SEQ ID NO | Light chain 2 SEQ ID NO | Heavy chain SEQ ID NO |
|---|---|---|---|---|
| 376995 | 092_9C8_IgG.002_3.2_VH_CL(S176E).001 | 1740 | 1742 | 1744 |
| 377000 | 093_23B3_VH4_IgG.002_Adalimumab_VH_CK(S176E).001 | 1746 | 1748 | 1750 |
| 377005 | 094_23B3_VH4_IgG.002_3.2_VH_CL(S176E).001 | 1752 | 1754 | 1756 |
| 377010 | 095_Adalimumab_CK(S176K)_Fc.001_3B3v2_VH_CK(S176E).001 | 1758 | 1760 | 1762 |
| 377015 | 096_Adalimumab_CK(S176K)_Fc.001_9C8_VH_CK(S176E).001 | 1764 | 1766 | 1768 |
| 377020 | 097_Adalimumab_CK(S176K)_Fc.001_23B3_VH4_VH_CK(S176E).001 | 1770 | 1772 | 1774 |
| 377025 | 098_3.2_CL(S176K)_Fc.001_3B3v2_VH_CK(S176E).001 | 1776 | 1778 | 1780 |
| 377030 | 099_3.2_CL(S176K)_Fc.001_9C8_VH_CK(S176E).001 | 1782 | 1784 | 1786 |
| 377035 | 100_3.2_CL(S176K)_Fc.001_23B3_VH4_VH_CK(S176E).001 | 1788 | 1790 | 1792 |
| 377040 | 101_3B3v2_CK(S176K)_Fc.001_Adalimumab_VH_CK(S176E).001 | 1794 | 1796 | 1798 |
| 377045 | 102_3B3v2_CK(S176K)_Fc.001_3.2_VH_CL(S176E).001 | 1800 | 1802 | 1804 |
| 377050 | 103_9C8_CK(S176K)_Fc.001_Adalimumab_VH_CK(S176E).001 | 1806 | 1808 | 1810 |
| 377055 | 104_9C8_CK(S176K)_Fc.001_3.2_VH_CL(S176E).001 | 1812 | 1814 | 1816 |
| 377060 | 105_23B3_VH4_CK(S176K)_Fc.001_Adalimumab_VH_CK(S176E).001 | 1818 | 1820 | 1822 |
| 377064 | 106_23B3_VH4_CK(S176K)_Fc.001_3.2_VH_CL(S176E).001 | 1824 | 1826 | 1828 |
| 377068 | 117_Adalimumab_IgG.003_3B3v2_VH_CH1(S183E).002 | 1830 | 1832 | 1834 |
| 377072 | 118_Adalimumab_IgG.003_9C8_VH_CH1(S183E).002 | 1836 | 1838 | 1840 |
| 377077 | 119_Adalimumab_IgG.003_23B3_VH4_VH_CH1(S183E).002 | 1842 | 1844 | 1846 |
| 377082 | 120_3.2_IgG.003_3B3v2_VH_CH1(S183E).002 | 1848 | 1850 | 1852 |
| 377087 | 121_3.2_IgG.003_9C8_VH_CH1(S183E).002 | 1854 | 1856 | 1858 |
| 377092 | 122_3.2_IgG.003_23B3_VH4_VH_CH1(S183E).002 | 1860 | 1862 | 1864 |
| 377097 | 123_3B3v2_IgG.003_Adalimumab_VH_CH1(S183E).002 | 1866 | 1868 | 1870 |
| 377102 | 124_3B3v2_IgG.003_3.2_VH_CH1(S183E).002 | 1872 | 1874 | 1876 |
| 377107 | 125_9C8_IgG.003_Adalimumab_VH_CH1(S183E).002 | 1878 | 1880 | 1882 |
| 377112 | 126_9C8_IgG.003_3.2_VH_CH1(S183E).002 | 1884 | 1886 | 1888 |
| 377116 | 127_23B3_VH4_IgG.003_Adalimumab_VH_CH1(S183E).002 | 1890 | 1892 | 1894 |
| 377121 | 128_23B3_VH4_IgG.003_3.2_VH_CH1(S183E).002 | 1896 | 1898 | 1900 |
| 377126 | 129_Adalimumab_CK(S176K)_Fc.002_3B3v2_VH_CH1(S183E).002 | 1902 | 1904 | 1906 |
| 377133 | 130_Adalimumab_CK(S176K)_Fc.002_9C8_VH_CH1(S183E).002 | 1908 | 1910 | 1912 |
| 377138 | 131_Adalimumab_CK(S176K)_Fc.002_23B3_VH4_VH_CH1(S183E).002 | 1914 | 1916 | 1918 |
| 377142 | 132_3.2_CL(S176K)_Fc.002_3B3v2_VH_CH1(S183E).002 | 1920 | 1922 | 1924 |
| 377148 | 133_3.2_CL(S176K)_Fc.002_9C8_VH_CH1(S183E).002 | 1926 | 1928 | 1930 |
| 377152 | 134_3.2_CL(S176K)_Fc.002_23B3_VH4_VH_CH1(S183E).002 | 1932 | 1934 | 1936 |
| 377156 | 135_3B3v2_CK(S176K)_Fc.002_Adalimumab_VH_CH1(S183E).002 | 1938 | 1940 | 1942 |
| 377162 | 136_3B3v2_CK(S176K)_Fc.002_3.2_VH_CH1(S183E).002 | 1944 | 1946 | 1948 |
| 377166 | 137_9C8_CK(S176K)_Fc.002_Adalimumab_VH_CH1(S183E).002 | 1950 | 1952 | 1954 |
| 377172 | 138_9C8_CK(S176K)_Fc.002_3.2_VH_CH1(S183E).002 | 1956 | 1958 | 1960 |
| 377176 | 139_23B3_VH4_CK(S176K)_Fc.002_Adalimumab_VH_CH1(S183E).002 | 1962 | 1964 | 1966 |
| 377182 | 140_23B3_VH4_CK(S176K)_Fc.002_3.2_VH_CH1(S183E).002 | 1968 | 1970 | 1972 |
| 377186 | 141_Adalimumab_IgG.003_3B3v2_VH_CK(S176E).002 | 1974 | 1976 | 1978 |
| 377193 | 142_Adalimumab_IgG.003_9C8_VH_CK(S176E).002 | 1980 | 1982 | 1984 |
| 377200 | 143_Adalimumab_IgG.003_23B3_VH4_VH_CK(S176E).002 | 1986 | 1988 | 1990 |
| 377207 | 144_3.2_IgG.003_3B3v2_VH_CK(S176E).002 | 1992 | 1994 | 1996 |
| 377212 | 145_3.2_IgG.003_9C8_VH_CK(S176E).002 | 1998 | 2000 | 2002 |
| 377217 | 146_3.2_IgG.003_23B3_VH4_VH_CK(S176E).002 | 2004 | 2006 | 2008 |
| 377222 | 147_3B3v2_IgG.003_Adalimumab_VH_CK(S176E).002 | 2010 | 2012 | 2014 |
| 377229 | 148_3B3v2_IgG.003_3.2_VH_CL(S176E).002 | 2016 | 2018 | 2020 |
| 377236 | 149_9C8_IgG.003_Adalimumab_VH_CK(S176E).002 | 2022 | 2024 | 2026 |
| 377241 | 150_9C8_IgG.003_3.2_VH_CL(S176E).002 | 2028 | 2030 | 2032 |
| 377246 | 151_23B3_VH4_IgG.003_Adalimumab_VH_CK(S176E).002 | 2034 | 2036 | 2038 |
| 377251 | 152_23B3_VH4_IgG.003_3.2_VH_CL(S176E).002 | 2040 | 2042 | 2044 |
| 377256 | 153_Adalimumab_CK(S176K)_Fc.002_3B3v2_VH_CK(S176E).002 | 2046 | 2048 | 2050 |
| 377261 | 154_Adalimumab_CK(S176K)_Fc.002_9C8_VH_CK(S176E).002 | 2052 | 2054 | 2056 |
| 377266 | 155_Adalimumab_CK(S176K)_Fc.002_23B3_VH4_VH_CK(S176E).002 | 2058 | 2060 | 2062 |
| 377271 | 156_3.2_CL(S176K)_Fc.002_3B3v2_VH_CK(S176E).002 | 2064 | 2066 | 2068 |
| 377276 | 157_3.2_CL(S176K)_Fc.002_9C8_VH_CK(S176E).002 | 2070 | 2072 | 2074 |
| 377281 | 158_3.2_CL(S176K)_Fc.002_23B3_VH4_VH_CK(S176E).002 | 2076 | 2078 | 2080 |
| 377286 | 159_3B3v2_CK(S176K)_Fc.002_Adalimumab_VH_CK(S176E).002 | 2082 | 2084 | 2086 |
| 377290 | 160_3B3v2_CK(S176K)_Fc.002_3.2_VH_CL(S176E).002 | 2088 | 2090 | 2092 |
| 377295 | 161_9C8_CK(S176K)_Fc.002_Adalimumab_VH_CK(S176E).002 | 2094 | 2096 | 2098 |
| 377300 | 162_9C8_CK(S176K)_Fc.002_3.2_VH_CL(S176E).002 | 2100 | 2102 | 2104 |
| 377305 | 163_23B3_VH4_CK(S176K)_Fc.002_Adalimumab_VH_CK(S176E).002 | 2106 | 2108 | 2110 |
| 377310 | 164_23B3_VH4_CK(S176K)_Fc.002_3.2_VH_CL(S176E).002 | 2112 | 2114 | 2116 |

The foregoing amino acid sequences are encoded by the nucleic acid sequences immediately preceding them in the Sequence Listing.

The CDR sequences of the VL and VH domains of the foregoing are as shown in Tables 21.2A and 21.2B below.

TABLE 21.2A anti-TL1A/anti-TNF-α IgG-Fab VL CDR sequences

| Ab | Type | CDRL1 | CDRL2 | CDRL3 |
|---|---|---|---|---|
| Anti-TNF-alpha (Adalimumab) | NA | CGCGCGTCCCAGGGAATCCGGA ATTACCTCGCA SEQ ID NO: 957 | GCCGCCTCGACTCTTCA GAGT SEQ ID NO: 959 | CAGAGATACAACCGAGCGC CTTACACA SEQ ID NO: 960 |
| | AA | RASQGIRNYLA SEQ ID NO: 92 | AASTLQS SEQ ID NO: 242 | QRYNRAPYT SEQ ID NO: 96 |
| Anti-TNF-alpha (3.2) | NA | ACTGGGAGCAGTTCCAACATCG GGGCAGGTTATGATGTACAC SEQ ID NO: 962 | GGTAACAGCAATCGGCC CTCA SEQ ID NO: 965 | CAGTCCTATGACAGCAGCC TGAGTGGTTCGGTG SEQ ID NO: 1189 |
| | AA | TGSSSNIGAGYDVH SEQ ID NO: 146 | GNSNRPS SEQ ID NO: 148 | QSYDSSLSGSV SEQ ID NO: 150 |
| Anti-TL1A (3B3v2) | NA | AGGGCCAGTCAGAGTGTTAGAA GCAGTTACTTAGCC SEQ ID NO: 94 | GGTGCATCCAGCAGGGC CACT SEQ ID NO: 467 | CAGCAGTATGGTAGCTCAC CTACC SEQ ID NO: 104 |
| | AA | RASQSVRSSYLA SEQ ID NO: 122 | GASSRAT SEQ ID NO: 124 | QQYGSSPT SEQ ID NO: 126 |
| Anti-TL1A (9C8) | NA | CGGGCAAGTCAGAGCATTAACA ACTATTTAAAT SEQ ID NO: 263 | GCTGCATCCAGTTTGCA AAGT SEQ ID NO: 2117 | CAACAGAGTTACAGTACCC CTCGGACG SEQ ID NO: 2118 |
| | AA | RASQSINNYLN SEQ ID NO: 110 | AASSLQS SEQ ID NO: 112 | QQSYSTPRT SEQ ID NO: 108 |
| Anti-TL1A (23B3) | NA | AGGTCCAGCCAGAGTGTGTTAT ACAGCTCCAACAATAAGAACTA CTTAGTT SEQ ID NO: 2119 | TGGGCATCTACCCGGGA ATCC SEQ ID NO: 2120 | CAGCAATATTATAAGACTC CTCTCACT SEQ ID NO: 2121 |
| | AA | RSSQSVLYSSNNKNYLV SEQ ID NO: 128 | WASTRES SEQ ID NO: 118 | QQYYKTPLT SEQ ID NO: 120 |

TABLE 21.2B anti-TL1A/anti-TNF-α IgG-Fab VH CDR sequences

| Ab | Type | CDRH1 | CDRH2 | CDRH3 |
|---|---|---|---|---|
| Anti-TNF-alpha (Adalimumab) | NA | GATTATGCGATGCAT SEQ ID NO: 2122 | GCCATTACGTGGAATAGCGGAC ACATCGATTATGCAGACAGTGT GGAGGGC SEQ ID NO: 2123 | GTCTCCTACTTGTCTACAGCTT CGTCGCTCGACTAT SEQ ID NO: 2124 |
| | AA | DYAMH SEQ ID NO: 158 | AITWNSGHIDYADSVEG SEQ ID NO: 160 | VSYLSTASSLDY SEQ ID NO: 162 |
| Anti-TNF-alpha (3.2) | NA | AGCTACTGGATCGGC SEQ ID NO: 2125 | ATCATCTATCTTGGTGACTCAG ATACCAGATACAGCCCGTCCTT CCAAGGC SEQ ID NO: 2126 | AGTAACTGGGGTCTTGACTAC SEQ ID NO: 2127 |
| | AA | SYWIG SEQ ID NO: 212 | IIYLGDSDTRYSPSFQG SEQ ID NO: 214 | SNWGLDY SEQ ID NO: 216 |
| Anti-TL1A (3B3v2) | NA | GGTTACTACTGGAAC SEQ ID NO: 2128 | GAAATCAATCATGCTGGAAACA CCAACTACAACCCGTCCCTCAA GAGT SEQ ID NO: 2129 | GGATATTGTAGAAGTACCACC TGCTACTTTGACTAC SEQ ID NO: 2130 |
| | AA | GYYWN SEQ ID NO: 188 | EINHAGNTNYNPSLKS SEQ ID NO: 190 | GYCRSTTCYFDY SEQ ID NO: 192 |
| Anti-TL1A (9C8) | NA | AGTTACTTCTGGAGC SEQ ID NO: 2131 | TATATCTATTACAGTGGGCAGA CCAAATACAACCCCTCCCTCAA GAGT SEQ ID NO: 2132 | GAAACTGGGAGCTACTACGGC TTTGACTAC SEQ ID NO: 2133 |
| | AA | SYFWS SEQ ID NO: 170 | YIYYSGQTKYNPSLKS SEQ ID NO: 633 | ETGSYYGFDY SEQ ID NO: 180 |

TABLE 21.2B-continued anti-TL1A/anti-TNF-α IgG-Fab VH CDR sequences

| Ab | Type | CDRH1 | CDRH2 | CDRH3 |
|---|---|---|---|---|
| Anti-TL1A (23B3) | NA | ACCAACAGTGTTGCT TGGAAC | AGGACATACTACAGGTCCAAGT GGTATAATGATTATGCAGTTTC TCTGAAAAGT | GAGGATGGGGATAGCTACTAC CGCTACGGTATGGACGTC |
|  |  | SEQ ID NO: 2134 | SEQ ID NO: 2135 | SEQ ID NO: 2136 |
|  | AA | TNSVAWN | RTYYRSKWYNDYAVSLKS | EDGDSYYRYGMDV |
|  |  | SEQ ID NO: 182 | SEQ ID NO: 196 | SEQ ID NO: 186 |

TABLE 21.3

Titer, Recovery, and Activity of IgG-Fabs

| iPS No. | IgG | Fab | CL/CH1 Swap | CPM | Titer (mg/L) | Recovery (mg/L) | hu TL1A (pM) | hu TL1A Fold Change | hu TNFα (pM) | hu TNFα Fold Change |
|---|---|---|---|---|---|---|---|---|---|---|
| 376597 | TNFa (ada) | TL1A (3B3v2) | No swap | v1 | 63.5 | 56.26698 | 197.3 | 3.653704 | 87.5 | 0.603448 |
| 376601 | TNFa (ada) | TL1A (9C8) | No swap | v1 | 49.4 | 44.46469 | 136.5 | 0.903974 | 96.5 | 0.665517 |
| 376605 | TNFa (ada) | TL1A (23B3) | No swap | v1 | 46 | 37.35632 | 689.6 | 5.56129 | 941.7 | 6.494483 |
| 376609 | TNFa (3.2) | TL1A (3B3v2) | No swap | v1 | 28.9 | 37.88288 | 4408 | 81.62963 | 94.2 | 1.345714 |
| 376613 | TNFa (3.2) | TL1A (9C8) | No swap | v1 | 34.5 | 41.14599 | 260.3 | 1.723841 | 75.3 | 1.075714 |
| 376617 | TNFa (3.2) | TL1A (23B3) | No swap | v1 | 30.3 | 37.13529 | 1025 | 8.266129 | 79.6 | 1.137143 |
| 376621 | TL1A (3B3v2) | TNFa (ada) | No swap | v1 | 53.1 | 55.23171 | 66.3 | 1.227778 | 33.3 | 0.229655 |
| 376625 | TL1A (3B3v2) | TNFa (3.2) | No swap | v1 | 51.2 | 62.13592 | 63.8 | 1.181481 | 37.3 | 0.532857 |
| 376629 | TL1A (9C8) | TNFa (ada) | No swap | v1 | 46.1 | 43.10706 | 142.1 | 0.94106 | 22.4 | 0.154483 |
| 376633 | TL1A (9C8) | TNFa (3.2) | No swap | v1 | 44.3 | 53.37693 | 215.7 | 1.428477 | 44.6 | 0.637143 |
| 376637 | TL1A (23B3) | TNFa (ada) | No swap | v1 | 45.9 | 43.74483 | 348.8 | 2.812903 | 27.5 | 0.189655 |
| 376641 | TL1A (23B3) | TNFa (3.2) | No swap | v1 | 49.7 | 56.93 | 208.8 | 1.683871 | 43.9 | 0.627143 |
| 376645 | TNFa (ada) | TL1A (3B3v2) | N-term swap | v1 | 5.82 | 4.959868 | 139.1 | 2.575926 | 131 | 0.903448 |
| 376651 | TNFa (ada) | TL1A (9C8) | N-term swap | v1 | 5.73 | 7.33602 | 337.8 | 2.237086 | 157.5 | 1.086207 |
| 376655 | TNFa (ada) | TL1A (23B3) | N-term swap | v1 | 6.54 | 6.945786 | 200.2 | 1.614516 | 198.5 | 1.368966 |
| 376659 | TNFa (3.2) | TL1A (3B3v2) | N-term swap | v1 | 7.33 | 7.576692 | 73.6 | 1.362963 | 92.4 | 1.32 |
| 376665 | TNFa (3.2) | TL1A (9C8) | N-term swap | v1 | 18.3 | 20.86174 | 91 | 0.602649 | 41.7 | 0.595714 |
| 376669 | TNFa (3.2) | TL1A (23B3) | N-term swap | v1 | 21.8 | 21.92793 | 77.6 | 0.625806 | 73.5 | 1.05 |
| 376673 | TL1A (3B3v2) | TNFa (ada) | N-term swap | v1 | 27.3 | 27.46576 | 4825 | 89.35185 | 41.7 | 0.287586 |
| 376679 | TL1A (3B3v2) | TNFa (3.2) | N-term swap | v1 | 28.8 | 40.93307 | 6250 | 115.7407 | 39.6 | 0.565714 |
| 376683 | TL1A (9C8) | TNFa (ada) | N-term swap | v1 | 33.4 | 28.83716 | 414 | 2.741722 | 35.2 | 0.242759 |
| 376689 | TL1A (9C8) | TNFa (3.2) | N-term swap | v1 | 32.4 | 39.77615 | 787.1 | 5.212583 | 45 | 0.642857 |
| 376693 | TL1A (23B3) | TNFa (ada) | N-term swap | v1 | 25.4 | 19.95322 |  |  | 29.5 | 0.203448 |
| 376699 | TL1A (23B3) | TNFa (3.2) | N-term swap | v1 | 22.9 | 25.85043 |  |  | 40.7 | 0.581429 |
| 376703 | TNFa (ada) | TL1A (3B3v2) | C-term swap | v1 | 39.2 | 30.58153 | 150.4 | 2.785185 | 78.6 | 0.542069 |
| 376709 | TNFa (ada) | TL1A (9C8) | C-term swap | v1 | 50 | 41.99633 | 199.5 | 1.321192 | 80.4 | 0.554483 |
| 376715 | TNFa (ada) | TL1A (23B3) | C-term swap | v1 | 40.7 | 29.97569 | 640.4 | 5.164516 | 64.2 | 0.442759 |
| 376721 | TNFa (3.2) | TL1A (3B3v2) | C-term swap | v1 | 23.2 | 24.91097 | 213.2 | 3.948148 | 92.8 | 1.325714 |
| 376725 | TNFa (3.2) | TL1A (9C8) | C-term swap | v1 | 26.2 | 31.24415 | 185.8 | 1.230464 | 48.3 | 0.69 |

TABLE 21.3-continued

Titer, Recovery, and Activity of IgG-Fabs

| iPS No. | IgG | Fab | CL/CH1 Swap | CPM | Titer (mg/L) | Recovery (mg/L) | hu TL1A (pM) | hu TL1A Fold Change | hu TNFα (pM) | hu TNFα Fold Change |
|---|---|---|---|---|---|---|---|---|---|---|
| 376729 | TNFa (3.2) | TL1A (23B3) | C-term swap | v1 | 31.7 | 28.69498 | 330.8 | 2.667742 | 79 | 1.128571 |
| 376733 | TL1A (3B3v2) | TNFa (ada) | C-term swap | v1 | 36.9 | 31.95548 | 66.1 | 1.224074 | 263 | 1.813793 |
| 376739 | TL1A (3B3v2) | TNFa (3.2) | C-term swap | v1 | 2.95 | 1.921946 | | | | |
| 376745 | TL1A (9C8) | TNFa (ada) | C-term swap | v1 | 24.9 | 22.1839 | 108.7 | 0.719868 | 135.3 | 0.933103 |
| 376750 | TL1A (9C8) | TNFa (3.2) | C-term swap | v1 | 7.71 | 8.223697 | 223 | 1.476821 | 71.4 | 1.02 |
| 376755 | TL1A (23B3) | TNFa (ada) | C-term swap | v1 | 9.11 | 7.361222 | 271.5 | 2.189516 | 433.3 | 2.988276 |
| 376760 | TL1A (23B3) | TNFa (3.2) | C-term swap | v1 | 7.17 | 5.960717 | 305.6 | 2.464516 | 129.8 | 1.854286 |
| 376765 | TNFa (ada) | TL1A (3B3v2) | Both swap | v1 | 3.66 | 4.304958 | 343.6 | 6.362963 | 182 | 1.255172 |
| 376770 | TNFa (ada) | TL1A (9C8) | Both swap | v1 | 2.68 | 1.712581 | | | | 0 |
| 376775 | TNFa (ada) | TL1A (23B3) | Both swap | v1 | 4.99 | 2.967115 | 389.7 | 3.142742 | 90.4 | 0.623448 |
| 376779 | TNFa (3.2) | TL1A (3B3v2) | Both swap | v1 | 4.92 | 3.717088 | 707.1 | 13.09444 | 226.8 | 3.24 |
| 376785 | TNFa (3.2) | TL1A (9C8) | Both swap | v1 | 9.36 | 9.546385 | 149.5 | 0.990066 | 42 | 0.6 |
| 376789 | TNFa (3.2) | TL1A (23B3) | Both swap | v1 | 12.2 | 11.32345 | 554.2 | 4.469355 | 74 | 1.057143 |
| 376793 | TL1A (3B3v2) | TNFa (ada) | Both swap | v1 | 19.3 | 15.35021 | 1937.5 | 35.87963 | 347.9 | 2.39931 |
| 376797 | TL1A (3B3v2) | TNFa (3.2) | Both swap | v1 | 1 | 0 | | | | |
| 376801 | TL1A (9C8) | TNFa (ada) | Both swap | v1 | 13.6 | 11.14213 | 286.8 | 1.899338 | 310 | 2.137931 |
| 376806 | TL1A (9C8) | TNFa (3.2) | Both swap | v1 | 1 | 0.961822 | | | | |
| 376811 | TL1A (23B3) | TNFa (ada) | Both swap | v1 | 3.22 | 1.671524 | | | | |
| 376817 | TL1A (23B3) | TNFa (3.2) | Both swap | v1 | 1 | 0 | | | | |
| 376822 | TNFa (ada) | TL1A (3B3v2) | No swap | v2 | 53.6 | 43.05822 | 128.5 | 2.37963 | 84.7 | 0.584138 |
| 376826 | TNFa (ada) | TL1A (9C8) | No swap | v2 | 27.4 | 22.92398 | 106 | 0.701987 | 80.8 | 0.557241 |
| 376830 | TNFa (ada) | TL1A (23B3) | No swap | v2 | 34.2 | 25.0415 | 262 | 2.112903 | 73.3 | 0.505517 |
| 376834 | TNFa (3.2) | TL1A (3B3v2) | No swap | v2 | 18 | 17.62724 | 246.8 | 4.57037 | 97 | 1.385714 |
| 376838 | TNFa (3.2) | TL1A (9C8) | No swap | v2 | 17.3 | 17.06775 | 548.8 | 3.634437 | 31.6 | 0.451429 |
| 376842 | TNFa (3.2) | TL1A (23B3) | No swap | v2 | 14.9 | 12.78592 | 469.85 | 3.789113 | 82.9 | 1.184286 |
| 376846 | TL1A (3B3v2) | TNFa (ada) | No swap | v2 | 46.7 | 45.57382 | 71.8 | 1.32963 | 31.5 | 0.217241 |
| 376850 | TL1A (3B3v2) | TNFa (3.2) | No swap | v2 | 24.4 | 25.47009 | 83.3 | 1.542593 | 84.8 | 1.211429 |
| 376854 | TL1A (9C8) | TNFa (ada) | No swap | v2 | 39.5 | 36.01855 | 229.3 | 1.518543 | 30.8 | 0.212414 |
| 376858 | TL1A (9C8) | TNFa (3.2) | No swap | v2 | 17.5 | 17.37068 | 190.8 | 1.263576 | 35 | 0.5 |
| 376862 | TL1A (23B3) | TNFa (ada) | No swap | v2 | 23.5 | 19.86708 | 436.3 | 3.518548 | 34.4 | 0.237241 |
| 376867 | TL1A (23B3) | TNFa (3.2) | No swap | v2 | 11.3 | 10.11778 | 109 | 0.879032 | 29 | 0.414286 |
| 376872 | TNFa (ada) | TL1A (3B3v2) | N-term swap | v2 | 5.26 | 5.362855 | 27.725 | 0.513426 | 519.5 | 3.582759 |
| 376879 | TNFa (ada) | TL1A (9C8) | N-term swap | v2 | 4.24 | 2.812933 | 253.2 | 1.676821 | 173.2 | 1.194483 |
| 376885 | TNFa (ada) | TL1A (23B3) | N-term swap | v2 | 3.01 | 2.592265 | 310.3 | 2.502419 | 940.8 | 6.488276 |
| 376889 | TNFa (3.2) | TL1A (3B3v2) | N-term swap | v2 | 1 | 0.817101 | | | | |
| 376897 | TNFa (3.2) | TL1A (9C8) | N-term swap | v2 | 2.76 | 5.494626 | 760 | 5.033113 | 472.9 | 6.755714 |
| 376902 | TNFa (3.2) | TL1A (23B3) | N-term swap | v2 | 1 | 0.985458 | | | | |

TABLE 21.3-continued

Titer, Recovery, and Activity of IgG-Fabs

| iPS No. | IgG | Fab | CL/CH1 Swap | CPM | Titer (mg/L) | Recovery (mg/L) | hu TL1A (pM) | hu TL1A Fold Change | hu TNFα (pM) | hu TNFα Fold Change |
|---|---|---|---|---|---|---|---|---|---|---|
| 376907 | TL1A (3B3v2) | TNFa (ada) | N-term swap | v2 | 36.7 | 29.31227 | 3213 | 59.5 | 35.8 | 0.246897 |
| 376913 | TL1A (3B3v2) | TNFa (3.2) | N-term swap | v2 | 19.4 | 25.22426 | 813 | 15.05556 | 52.55 | 0.750714 |
| 376918 | TL1A (9C8) | TNFa (ada) | N-term swap | v2 | 39.6 | 31.18441 | 203.6 | 1.348344 | 17.855 | 0.123138 |
| 376925 | TL1A (9C8) | TNFa (3.2) | N-term swap | v2 | 22.4 | 27.25854 | 189.65 | 1.25596 | 29.35 | 0.419286 |
| 376931 | TL1A (23B3) | TNFa (ada) | N-term swap | v2 | 22.9 | 20.43729 | 7195 | 58.02419 | 26.77 | 0.184621 |
| 376937 | TL1A (23B3) | TNFa (3.2) | N-term swap | v2 | 12.2 | 9.722544 | | | 176.95 | 2.527857 |
| 376941 | TNFa (ada) | TL1A (3B3v2) | C-term swap | v2 | 40.6 | 31.79866 | 22.73 | 0.420926 | 50.4 | 0.347586 |
| 376949 | TNFa (ada) | TL1A (9C8) | C-term swap | v2 | 38.7 | 35.043 | 48.165 | 0.318974 | 49.095 | 0.338586 |
| 376955 | TNFa (ada) | TL1A (23B3) | C-term swap | v2 | 30 | 24.1244 | 333.95 | 2.693145 | 57.15 | 0.394138 |
| 376962 | TNFa (3.2) | TL1A (3B3v2) | C-term swap | v2 | 9.96 | 13.79268 | 540 | 10 | 1957 | 27.95714 |
| 376967 | TNFa (3.2) | TL1A (9C8) | C-term swap | v2 | 8.73 | 12.01796 | | | | |
| 376972 | TNFa (3.2) | TL1A (23B3) | C-term swap | v2 | 2.58 | 4.419175 | 12490 | 100.7258 | 7870 | 112.4286 |
| 376976 | TL1A (3B3v2) | TNFa (ada) | C-term swap | v2 | 26.3 | 16.32049 | 31.31 | 0.579815 | 172.2 | 1.187586 |
| 376983 | TL1A (3B3v2) | TNFa (3.2) | C-term swap | v2 | 1 | 0.993437 | | | | |
| 376991 | TL1A (9C8) | TNFa (ada) | C-term swap | v2 | 40.5 | 38.42849 | 59.9 | 0.396689 | 148 | 1.02069 |
| 376995 | TL1A (9C8) | TNFa (3.2) | C-term swap | v2 | 1 | 0.339488 | | | | |
| 377001 | TL1A (23B3) | TNFa (ada) | C-term swap | v2 | 25.8 | 25.49058 | 41.675 | 0.336089 | 158.45 | 1.092759 |
| 377006 | TL1A (23B3) | TNFa (3.2) | C-term swap | v2 | 1 | 0.124147 | | | | |
| 377011 | TNFa (ada) | TL1A (3B3v2) | Both swap | v2 | 1 | 3.586728 | 2702 | 50.03704 | 3065.5 | 21.14138 |
| 377015 | TNFa (ada) | TL1A (9C8) | Both swap | v2 | 3.2 | 3.312442 | | | 141050 | 972.7586 |
| 377020 | TNFa (ada) | TL1A (23B3) | Both swap | v2 | 1 | 1.15137 | | | | |
| 377025 | TNFa (3.2) | TL1A (3B3v2) | Both swap | v2 | 1 | 0.778064 | | | | |
| 377031 | TNFa (3.2) | TL1A (9C8) | Both swap | v2 | 1 | 2.940239 | 17640 | 116.8212 | 12965 | 185.2143 |
| 377036 | TNFa (3.2) | TL1A (23B3) | Both swap | v2 | 1 | 0.595615 | | | | |
| 377041 | TL1A (3B3v2) | TNFa (ada) | Both swap | v2 | 10.8 | 10.82989 | 1689.5 | 31.28704 | 2014.5 | 13.8931 |
| 377045 | TL1A (3B3v2) | TNFa (3.2) | Both swap | v2 | 1 | 0 | | | | |
| 377050 | TL1A (9C8) | TNFa (ada) | Both swap | v2 | 22.1 | 16.88003 | 269.05 | 1.781788 | 67.2 | 0.463448 |
| 377056 | TL1A (9C8) | TNFa (3.2) | Both swap | v2 | 1 | 0 | | | | |
| 377060 | TL1A (23B3) | TNFa (ada) | Both swap | v2 | 1 | 3.78306 | 2371 | 19.12097 | 171.5 | 1.182759 |
| 377064 | TL1A (23B3) | TNFa (3.2) | Both swap | v2 | 1 | 0 | | | | |
| 377068 | TNFa (ada) | TL1A (3B3v2) | No swap | v3 | 69.2 | 61.35414 | 23.5 | 0.435185 | 56.1 | 0.386897 |
| 377073 | TNFa (ada) | TL1A (9C8) | No swap | v3 | 64.9 | 57.53099 | 47.08 | 0.311788 | 36.795 | 0.253759 |
| 377077 | TNFa (ada) | TL1A (23B3) | No swap | v3 | 60 | 50.44568 | 67.9 | 0.547581 | 49.66 | 0.342483 |
| 377082 | TNFa (3.2) | TL1A (3B3v2) | No swap | v3 | 35.6 | 50.01275 | 194.9 | 3.609259 | 1213.5 | 17.33571 |
| 377087 | TNFa (3.2) | TL1A (9C8) | No swap | v3 | 44.7 | 33.18984 | 148.8 | 0.98543 | 41.555 | 0.593643 |
| 377092 | TNFa (3.2) | TL1A (23B3) | No swap | v3 | 35 | 43.58861 | 598.5 | 4.826613 | 38.845 | 0.554929 |
| 377097 | TL1A (3B3v2) | TNFa (ada) | No swap | v3 | 70.5 | 74.25303 | 37.29 | 0.690556 | 20.85 | 0.143793 |

TABLE 21.3-continued

Titer, Recovery, and Activity of IgG-Fabs

| iPS No. | IgG | Fab | CL/CH1 Swap | CPM | Titer (mg/L) | Recovery (mg/L) | hu TL1A (pM) | hu TL1A Fold Change | hu TNFα (pM) | hu TNFα Fold Change |
|---|---|---|---|---|---|---|---|---|---|---|
| 377102 | TL1A (3B3v2) | TNFa (3.2) | No swap | v3 | 68.1 | 84.23872 | 31.565 | 0.584537 | 29.98 | 0.428286 |
| 377107 | TL1A (9C8) | TNFa (ada) | No swap | v3 | 57 | 55.22568 | 78.35 | 0.518874 | 16.775 | 0.11569 |
| 377112 | TL1A (9C8) | TNFa (3.2) | No swap | v3 | 37.9 | 45.76692 | 53.5 | 0.354305 | 26.315 | 0.375929 |
| 377116 | TL1A (23B3) | TNFa (ada) | No swap | v3 | 44.3 | 44.02405 | 73.9 | 0.595968 | 15.23 | 0.105034 |
| 377121 | TL1A (23B3) | TNFa (3.2) | No swap | v3 | 40.7 | 28.59812 | 62.55 | 0.504435 | 22.85 | 0.326429 |
| 377126 | TNFa (ada) | TL1A (3B3v2) | N-term swap | v3 | 1 | 1.981845 | | | | |
| 377133 | TNFa (ada) | TL1A (9C8) | N-term swap | v3 | 2.65 | 2.948434 | 806.5 | 5.34106 | 552 | 3.806897 |
| 377138 | TNFa (ada) | TL1A (23B3) | N-term swap | v3 | 1 | 1.33942 | | | | |
| 377142 | TNFa (3.2) | TL1A (3B3v2) | N-term swap | v3 | 10.2 | 11.75934 | 32.78 | 0.607037 | 45.34 | 0.647714 |
| 377148 | TNFa (3.2) | TL1A (9C8) | N-term swap | v3 | 11.1 | 13.07635 | 99.65 | 0.659934 | 48.495 | 0.692786 |
| 377152 | TNFa (3.2) | TL1A (23B3) | N-term swap | v3 | 13 | 12.69725 | 46.51 | 0.375081 | 39.74 | 0.567714 |
| 377156 | TL1A (3B3v2) | TNFa (ada) | N-term swap | v3 | 30.8 | 34.83478 | 1584.5 | 29.34259 | 19.9 | 0.137241 |
| 377162 | TL1A (3B3v2) | TNFa (3.2) | N-term swap | v3 | 26.2 | 34.40556 | 2504 | 46.37037 | 24.875 | 0.355357 |
| 377166 | TL1A (9C8) | TNFa (ada) | N-term swap | v3 | 31.9 | 26.76967 | 83 | 0.549669 | 16.955 | 0.116931 |
| 377172 | TL1A (9C8) | TNFa (3.2) | N-term swap | v3 | 31.3 | 38.70441 | 81.5 | 0.539735 | 27.26 | 0.389429 |
| 377176 | TL1A (23B3) | TNFa (ada) | N-term swap | v3 | 11.3 | 11.48623 | 5305 | 42.78226 | 28.73 | 0.198138 |
| 377182 | TL1A (23B3) | TNFa (3.2) | N-term swap | v3 | 14 | 15.5418 | 28185 | 227.2984 | 48.17 | 0.688143 |
| 377186 | TNFa (ada) | TL1A (3B3v2) | C-term swap | v3 | 46.4 | 36.6753 | 37.57 | 0.695741 | 35.75 | 0.246552 |
| 377193 | TNFa (ada) | TL1A (9C8) | C-term swap | v3 | 32 | 28.52527 | 128.05 | 0.848013 | 30.93 | 0.21331 |
| 377200 | TNFa (ada) | TL1A (23B3) | C-term swap | v3 | 56.6 | 43.6029 | 217.35 | 1.752823 | 38.425 | 0.265 |
| 377208 | TNFa (3.2) | TL1A (3B3v2) | C-term swap | v3 | 22.1 | 26.10432 | 212.35 | 3.932407 | 170.15 | 2.430714 |
| 377212 | TNFa (3.2) | TL1A (9C8) | C-term swap | v3 | 17.6 | 18.67336 | 874 | 5.788079 | 306.8 | 4.382857 |
| 377217 | TNFa (3.2) | TL1A (23B3) | C-term swap | v3 | 27.4 | 25.63219 | 271.4 | 2.18871 | 114.8 | 1.64 |
| 377223 | TL1A (3B3v2) | TNFa (ada) | C-term swap | v3 | 40.5 | 36.07182 | 30.175 | 0.558796 | 167 | 1.151724 |
| 377229 | TL1A (3B3v2) | TNFa (3.2) | C-term swap | v3 | 3.05 | 3.031093 | 79.5 | 1.472222 | 1711.5 | 24.45 |
| 377236 | TL1A (9C8) | TNFa (ada) | C-term swap | v3 | 48.3 | 43.315 | 54.25 | 0.359272 | 61.7 | 0.425517 |
| 377241 | TL1A (9C8) | TNFa (3.2) | C-term swap | v3 | 8.95 | 8.490845 | 606 | 4.013245 | 268.4 | 3.834286 |
| 377246 | TL1A (23B3) | TNFa (ada) | C-term swap | v3 | 22.4 | 20.52445 | 68.7 | 0.554032 | 118.5 | 0.817241 |
| 377252 | TL1A (23B3) | TNFa (3.2) | C-term swap | v3 | 5.05 | 5.690246 | 219.8 | 1.772581 | 1381 | 19.72857 |
| 377256 | TNFa (ada) | TL1A (3B3v2) | Both swap | v3 | 1 | 3.203042 | | | | |
| 377261 | TNFa (ada) | TL1A (9C8) | Both swap | v3 | 1 | 3.032322 | | | | |
| 377266 | TNFa (ada) | TL1A (23B3) | Both swap | v3 | 2.57 | 3.395799 | | | | |
| 377272 | TNFa (3.2) | TL1A (3B3v2) | Both swap | v3 | 1 | 3.071647 | 13300 | 246.2963 | | |
| 377276 | TNFa (3.2) | TL1A (9C8) | Both swap | v3 | 14 | 16.05846 | 1237.5 | 8.195364 | 362.4 | 5.177143 |
| 377281 | TNFa (3.2) | TL1A (23B3) | Both swap | v3 | 12.6 | 13.70576 | 1937.5 | 15.625 | 282.35 | 4.033571 |
| 377286 | TL1A (3B3v2) | TNFa (ada) | Both swap | v3 | 25.5 | 29.40929 | 486.7 | 9.012963 | 521.5 | 3.596552 |
| 377290 | TL1A (3B3v2) | TNFa (3.2) | Both swap | v3 | 1 | 0.304074 | | | | |

TABLE 21.3-continued

Titer, Recovery, and Activity of IgG-Fabs

| iPS No. | IgG | Fab | CL/CH1 Swap | CPM | Titer (mg/L) | Recovery (mg/L) | hu TL1A (pM) | hu TL1A Fold Change | hu TNFα (pM) | hu TNFα Fold Change |
|---|---|---|---|---|---|---|---|---|---|---|
| 377295 | TL1A (9C8) | TNFa (ada) | Both swap | v3 | 26.3 | 29.74724 | 177.55 | 1.175828 | 132.35 | 0.912759 |
| 377300 | TL1A (9C8) | TNFa (3.2) | Both swap | v3 | 3.58 | 4.355968 | 17575 | 116.3907 | 69750 | 996.4286 |
| 377305 | TL1A (23B3) | TNFa (ada) | Both swap | v3 | 11 | 13.60209 | | | 595.5 | 4.106897 |
| 377310 | TL1A (23B3) | TNFa (3.2) | Both swap | v3 | 1 | 0.64267 | | | | |

TABLE 21.4 anti-TL1A/anti-TNF-α IgG-Fab purity

| | SE-HPLC | | | Caliper | | | | | | | | |
|---|---|---|---|---|---|---|---|---|---|---|---|---|
| | pre-MP | | post- | Non-reduced | | | | Reduced | | | | |
| iPS No. | HMW | MP | MP | MP 1 | MP 2 | MP 3 | LMW | HC 1 | HC 2 | HC 3 | LC 1 | R LC 2 |
| 376597 | 3.832 | 96 | | 1 | | | 0 | 1 | | | 0.206897 | 0.793103 |
| 376601 | 2.894 | 97 | | 1 | | | 0 | 1 | | | 0.35316 | 0.64684 |
| 376605 | 3.362 | 96.634 | | 1 | | | 0 | 1 | | | 1 | |
| 376609 | 1.241 | 99 | | 1 | | | 0 | 0.153846 | 0.846154 | | 1 | |
| 376613 | 1.838 | 98 | | 1 | | | 0 | 1 | | | 0.298658 | 0.701342 |
| 376617 | 1.162 | 99 | | 1 | | | 0 | 1 | | | 1 | |
| 376621 | 1.827 | 98.172 | | 1 | | | 0 | 1 | | | 0 | 1 |
| 376625 | 2.552 | 97 | | 1 | | | 0 | 0.136503 | 0.863497 | | 0.511494 | 0.488506 |
| 376629 | 1.868 | 98 | | 1 | | | 0 | 1 | | | 0.521429 | 0.478571 |
| 376633 | 5.854 | 94 | | 1 | | | 0 | 1 | | | 0.454225 | 0.545775 |
| 376637 | 1.099 | 98.901 | | 1 | | | 0 | 1 | | | 0.683333 | 0.316667 |
| 376641 | 3.255 | 96.745 | | 1 | | | 0 | 1 | | | 0.44898 | 0.55102 |
| 376645 | 8.844 | 63.754 | | 1 | | | 0 | 1 | | | 0.336066 | 0.663934 |
| 376651 | 39.874 | 60 | | 0.46 | 0.54 | | 0 | 1 | | | 0.364929 | 0.635071 |
| 376655 | 8.191 | 91.809 | | | | | | 1 | | | 0.335052 | 0.664948 |
| 376659 | 3.515 | 96.485 | | 0.91 | | | 0.09 | 0.07438 | 0.92562 | | 0.514599 | 0.485401 |
| 376665 | 2.981 | 97 | | 1 | | | 0 | 1 | | | 0.498168 | 0.501832 |
| 376669 | 2.213 | 97.787 | | 1 | | | 0 | 1 | | | 1 | |
| 376673 | 4.635 | 60.842 | | 0.95 | | | 0.05 | 0.110115 | 0.889885 | | 1 | |
| 376679 | 1.774 | 98.226 | | 0.7 | | | 0.3 | 0.123494 | 0.203008 | 0.673499 | 1 | |
| 376683 | 5.787 | 94 | | 0.53 | 0.22 | | 0.25 | 1 | | | 0.330189 | 0.669811 |
| 376689 | 3.896 | 96.104 | | 0.7 | | | 0.3 | 1 | | | 0.209386 | 0.790614 |
| 376693 | 2.32 | 96.131 | 1.548 | 0.8 | | | 0.1 | 1 | | | 1 | |
| 376699 | 1.27 | 99 | | 0.715 | | | 0.285 | 1 | | | 1 | |
| 376703 | 7.46 | 93 | | 1 | | | 0 | 0.164756 | 0.835244 | | 0.437086 | 0.562914 |
| 376709 | 8.439 | 92 | | 1 | | | 0 | 1 | | | 0.43985 | 0.56015 |
| 376715 | 2.451 | 98 | | 0.4 | 0.6 | | 0 | 1 | | | 0.285124 | 0.714876 |
| 376721 | 5.544 | 94.456 | | 0.85 | | | 0.15 | 0.197595 | 0.802405 | | 0.327751 | 0.672249 |
| 376725 | 7.766 | 71.445 | | 1 | | | 0 | 1 | | | 0.413333 | 0.586667 |
| 376729 | 4.728 | 95 | | 1 | | | 0 | 1 | | | 0.414343 | 0.585657 |
| 376733 | 9.277 | 91 | | 1 | | | 0 | 1 | | | 0.474359 | 0.525641 |
| 376739 | 11.358 | 70.083 | | | | | | 1 | | | 0.719481 | 0.280519 |
| 376745 | 18.482 | 82 | | 1 | | | 0 | 1 | | | 0.479675 | 0.520325 |
| 376750 | 5.36 | 94.64 | | 1 | | | 0 | 0.153509 | 0.846491 | | 1 | |
| 376755 | 4.451 | 96 | | 1 | | | 0 | 1 | | | 0.509225 | 0.490775 |
| 376760 | 6.609 | 93.391 | | 1 | | | 0 | 1 | | | 1 | |
| 376765 | 4.751 | 57.868 | | 1 | | | 0 | 1 | | | 0.305136 | 0.694864 |
| 376770 | 7.176 | 50.33 | | | | | | 1 | | | 1 | |
| 376775 | 36 | 63.705 | | | | | | 1 | | | 0.527027 | 0.472973 |
| 376779 | 5.25 | 94.75 | | 1 | | | 0 | 1 | | | 0.416107 | 0.583893 |
| 376785 | 19.124 | 80.876 | | 1 | | | 0 | 1 | | | 0.443333 | 0.556667 |
| 376789 | 2.556 | 97 | | 1 | | | 0 | 1 | | | 0.385294 | 0.614706 |
| 376793 | 9.161 | 79.135 | | 1 | | | 0 | 0.120112 | 0.879888 | | 1 | |
| 376797 | | | | | | | | | | | | |
| 376801 | 16.037 | 83.963 | | 1 | | | 0 | 1 | | | 1 | |
| 376806 | 3.911 | 96 | | | | | | 1 | | | | |
| 376811 | 35.57 | 41.522 | | | | | | 1 | | | 1 | |
| 376817 | | | | | | | | | | | | |
| 376822 | 3.67 | 96 | | 1 | | | 0 | 1 | | | 0.304688 | 0.695313 |
| 376826 | 1.521 | 98.479 | | 1 | | | 0 | 0.097792 | 0.902208 | | 0.487738 | 0.512262 |
| 376830 | 3.377 | 14.015 | | 1 | | | 0 | 1 | | | 1 | |
| 376834 | 3.397 | 96.613 | | 1 | | | 0 | 0.495667 | 0.504333 | | 0.229858 | 0.770142 |

TABLE 21.4-continued anti-TL1A/anti-TNF-α IgG-Fab purity

| | SE-HPLC | | | Caliper | | | | | | | | |
|---|---|---|---|---|---|---|---|---|---|---|---|---|
| | pre-MP | | post- | Non-reduced | | | | Reduced | | | | |
| iPS No. | HMW | MP | MP | MP 1 | MP 2 | MP 3 | LMW | HC 1 | HC 2 | HC 3 | LC 1 | R LC 2 |
| 376838 | 2.644 | 97.356 | | 1 | | | 0 | 1 | | | 0.25463 | 0.74537 |
| 376842 | 2.839 | 97 | | 1 | | | 0 | 1 | | | 0.149877 | 0.850123 |
| 376846 | 2.28 | 97.72 | | 1 | | | 0 | 1 | | | 1 | |
| 376850 | 2.28 | 97.72 | | 1 | | | 0 | 0.332192 | 0.667808 | | 0.735577 | 0.264423 |
| 376854 | 0.963 | 99.037 | | 1 | | | 0 | 1 | | | 0.533951 | 0.466049 |
| 376858 | 2.903 | 97.097 | | 1 | | | 0 | 1 | | | 0.513889 | 0.486111 |
| 376862 | 2.567 | 97.433 | | 1 | | | 0 | 1 | | | 0.666667 | 0.333333 |
| 376867 | 2.062 | 97.938 | | 1 | | | 0 | 1 | | | 0.495702 | 0.504298 |
| 376872 | 50.192 | 50 | | | | | | 1 | | | 0.171254 | 0.828746 |
| 376879 | 10.705 | 65.812 | | | | | | 1 | | | 0.303207 | 0.696793 |
| 376885 | 1.202 | 77.072 | | | | | | 1 | | | 0.232628 | 0.767372 |
| 376889 | 9.579 | 83.982 | | | | | | | | | 0.546 | 0.454 |
| 376897 | 6.197 | 93.803 | | | | | | 1 | | | 0.540146 | 0.459854 |
| 376902 | 7.841 | 92.1259 | | | | | | 1 | | | 1 | |
| 376907 | 2.508 | 97.492 | | 0.81 | | | 0.19 | 0.213946 | 0.786054 | | 0.176152 | 0.823848 |
| 376913 | 1.59 | 98.41 | | 0.63763 | | | 0.3621 | 0.589091 | 0.410909 | | 0.142539 | 0.857461 |
| 376918 | 2.689 | 97 | | 0.607 | | | 0.393 | 1 | | | 0.310078 | 0.689922 |
| 376925 | 2.701 | 97.479 | | | | | 1 | 1 | | | 0.245283 | 0.754717 |
| 376931 | 3.825 | 17 | 23.971 | 0.845 | | | 0.15 | 1 | | | 1 | |
| 376937 | 6.425 | 73 | 6.777 | 1 | | | 0 | 1 | | | 1 | |
| 376941 | 6.09 | 93.91 | | 0.995 | | | 0 | 0.104452 | 0.895548 | | 0.456731 | 0.543269 |
| 376949 | 4.915 | 95.085 | | 0.136 | 0.805 | | 0.059 | 1 | | | 0.432161 | 0.567839 |
| 376955 | 3.589 | 96.411 | | 0.197 | 0.287 | 0.51 | 0 | 1 | | | 0.222841 | 0.777159 |
| 376962 | 5.594 | 86.48 | 7.926 | 0.636074 | 0.636074 | | 0.363926 | 1 | | | 0.321678 | 0.678322 |
| 376967 | 6.547 | 93.453 | | 1 | | | 0 | 1 | | | 0.486869 | 0.513131 |
| 376972 | 3.031 | 96.969 | | | | | | 1 | | | 0.42549 | 0.57451 |
| 376976 | 3.387 | 96.613 | | 1 | | | 0 | 1 | | | 0.487965 | 0.512035 |
| 376983 | 34.082 | 66 | | | | | | | | | | |
| 376991 | 9.467 | 90.533 | | 1 | | | 0 | 1 | | | 0.501219 | 0.498781 |
| 376995 | 0 | | | | | | | | | | | |
| 377001 | 2.545 | 97.455 | | 1 | | | 0 | 1 | | | 0.519288 | 0.480712 |
| 377006 | 0 | 66.136 | 33.864 | | | | | | | | | |
| 377011 | 2.172 | 79 | | | | | | 0.544944 | 0.455056 | | 0.247312 | 0.752688 |
| 377015 | 9.233 | 57 | | | | | | 1 | | | 1 | 0 |
| 377020 | 7.127 | 85 | 51.551 | | | | | | | | | |
| 377025 | 8.132 | 85 | 15.948 | | | | | | | | | |
| 377031 | 3.924 | 91 | | | | | | 0.473149 | 0.526851 | | 0.577419 | 0.422581 |
| 377036 | 3.788 | 96 | | | | | | | | | | |
| 377041 | 16.2361 | 83.982 | | 1 | | | 0 | 0.315871 | 0.684129 | | 1 | |
| 377045 | | | | | | | | | | | | |
| 377050 | 11.164 | 77 | 10.496 | 1 | | | 0 | 1 | | | 1 | |
| 377056 | | | | | | | | | | | | |
| 377060 | 7.075 | 77 | 33.064 | | | | | 1 | | | 1 | |
| 377064 | | | | | | | | | | | | |
| 377068 | 3.292 | 97 | | 1 | | | 0 | 1 | | | 0.299145 | 0.700855 |
| 377073 | 1.927 | 98.074 | | | | | | 1 | | | 0.376947 | 0.623053 |
| 377077 | 2.583 | 97 | | | | | | 1 | | | 0.110749 | 0.889251 |
| 377082 | 1.135 | 99 | | 1 | | | 0 | 0.225086 | 0.774914 | | 0.071429 | 0.928571 |
| 377087 | 2.006 | 97.929 | | 1 | | | 0 | 1 | | | 0.274933 | 0.725067 |
| 377092 | 1.994 | 98.006 | | 1 | | | 0 | 1 | | | 0.094395 | 0.905605 |
| 377097 | 1.261 | 98.739 | | 1 | | | 0 | 1 | | | 1 | |
| 377102 | 2.11 | 97.767 | | 1 | | | 0 | 0.164251 | 0.835749 | | 0.501319 | 0.498681 |
| 377107 | 1.501 | 98 | | 1 | | | 0 | 1 | | | 0.485893 | 0.514107 |
| 377112 | 3.322 | 97 | | 1 | | | 0 | 1 | | | 0.468657 | 0.531343 |
| 377116 | 2.65 | 97 | | 1 | | | 0 | 1 | | | 0.557003 | 0.442997 |
| 377121 | 3.284 | 97 | | 1 | | | 0 | 1 | | | 0.459701 | 0.540299 |
| 377126 | 12.404 | 66 | | | | | | 1 | | | 1 | |
| 377133 | 6.553 | 57 | | | | | | 1 | | | 0.436508 | 0.563492 |
| 377138 | 3.988 | 73 | | | | | | 1 | | | 0.400932 | 0.599068 |
| 377142 | 2.077 | 98 | | 1 | | | 0 | 1 | | | 0.52861 | 0.47139 |
| 377148 | 3.772 | 96 | | 1 | | | 0 | 1 | | | 0.529745 | 0.470255 |
| 377152 | 1.436 | 99 | | 1 | | | 0 | 1 | | | 0.50289 | 0.49711 |

TABLE 21.4-continued anti-TL1A/anti-TNF-α IgG-Fab purity

| | SE-HPLC | | | Caliper | | | | | | | | |
| | pre-MP | | post- | Non-reduced | | | | Reduced | | | | |
| iPS No. | HMW | MP | MP | MP 1 | MP 2 | MP 3 | LMW | HC 1 | HC 2 | HC 3 | LC 1 | R LC 2 |
|---|---|---|---|---|---|---|---|---|---|---|---|---|
| 377156 | 2.614 | 77 | | 1 | | | 0 | 0.118734 | 0.886544 | | 1 | |
| 377162 | 1.394 | 98.536 | | 0.64 | | | 0.33 | 0.065466 | 0.145663 | 0.485 | 0.172237 | 0.827763 |
| 377166 | 5.575 | 94 | 2.313 | 0.295 | 0.45 | | 0.254 | 1 | | | 0.359116 | 0.640884 |
| 377172 | 3.898 | 96 | | 0.261 | 0.325 | | 0.414 | 1 | | | 0.349333 | 0.650667 |
| 377176 | 19.399 | 77 | | 1 | | | 0 | 1 | | | 1 | |
| 377182 | 32.588 | 50 | | | | | 1 | 1 | | | 1 | |
| 377186 | 6.813 | 93 | | 1 | | | 0 | 0.171975 | 0.828025 | | 0.454054 | 0.545946 |
| 377193 | 1.394 | 98.605 | | 1 | | | 0 | 1 | | | 0.446108 | 0.553892 |
| 377200 | 5.103 | 95 | | 0.15 | 0.165 | 0.688 | 0 | 1 | | | 0.334448 | 0.665552 |
| 377208 | 3.092 | 97 | | 0.84 | | | 0.16 | 0.229787 | 0.770213 | | 0.338983 | 0.661017 |
| 377212 | 20.005 | 80 | | 0.867 | | | 0.133 | 1 | | | 0.412888 | 0.587112 |
| 377217 | 5.089 | 95 | | 1 | | | 0 | 1 | | | 0.44709 | 0.55291 |
| 377223 | 7.45 | 93 | | 1 | | | 0 | 0.065574 | 0.934426 | | 0.497423 | 0.502577 |
| 377229 | 20.138 | 62 | | | | | | 1 | | | 1 | |
| 377236 | 18.44 | 82 | | 1 | | | 0 | 1 | | | 0.488439 | 0.511561 |
| 377241 | 10.022 | 90 | | | | | | 1 | | | 1 | |
| 377246 | 7 | 92.694 | | 1 | | | 0 | 1 | | | 0.519878 | 0.480122 |
| 377252 | 16 | 83.804 | 6.111 | | | | | 1 | | | 1 | |
| 377256 | 0 | 100 | | | | | | | | | 1 | |
| 377261 | 0 | 100 | | 1 | | | 0 | | | | 1 | |
| 377266 | 0 | 100 | | | | | | 1 | | | 1 | |
| 377272 | 8.675 | 84 | | | | | | 1 | | | 0.387841 | 0.612159 |
| 377276 | 11.006 | 88.626 | | 1 | | | 0 | 1 | | | 0.486486 | 0.513514 |
| 377281 | 4.722 | 95.279 | | 1 | | | 0 | 1 | | | 0.485488 | 0.514512 |
| 377286 | 5.497 | 64 | | 1 | | | 0 | 0.134328 | 0.865672 | | 1 | |
| 377290 | 0 | 100 | | | | | | | | | | |
| 377295 | 13.807 | 10.899 | | 1 | | | 0 | 1 | | | 1 | |
| 377300 | 6.932 | 87 | | | | | | 1 | | | 0.566553 | 0.433447 |
| 377305 | 11.808 | 83 | | 1 | | | 0 | 0.331418 | 0.668582 | | 0.8125 | 0.1875 |
| 377310 | 0 | 100 | | | | | | | | | | |

All publications, patents, and patent applications discussed and cited herein are hereby incorporated by reference in their entireties. It is understood that the disclosed invention is not limited to the particular methodology, protocols and materials described as these can vary. It is also understood that the terminology used herein is for the purposes of describing particular embodiments only and is not intended to limit the scope of the appended claims.

Those skilled in the art will recognize, or be able to ascertain using no more than routine experimentation, many equivalents to the specific embodiments of the invention described herein. Such equivalents are intended to be encompassed by the claims that follow.

ABBREVIATIONS

Abbreviated terms used throughout this specification are defined as follows.
aa, AA amino acid
AEI allelic expression imbalance
ANOVA analysis of variance
BSA bovine serum albumin
CDR complementarity determining regions
CHO Chinese hamster ovary cells
CPM charge pair mutation
DMEM Dulbecco's Modified Eagle Medium
DMSO dimethyl sulfoxide
ELISA enzyme-linked immunosorbent assay
eQTL expression quantitative trait loci
ESI-TOF electrospray ionization time of flight
ESN exhausted supernatant
FACS fluorescence-activated cell sorting
FBS fetal bovine serum
FPLC fast protein liquid chromatography
FVB a strain of mice inbred for the Friend leukemia virus 1b (Fv1b) allele
H&E Hematoxylin and eosin
HA hypoxanthine
HIC hydrophobic interaction chromatography
HPLC high performance liquid chromatography
HRP horse radish peroxidase
HUVEC human umbilical vein epithelial cell
IBD inflammatory bowel disease
IDMEM DMEM without glutamine
IFN interferon
IL interleukin
MCP monocyte chemotactic protein
MSD macromolecular structure database
NA nucleic acid
PBMC peripheral blood mononuclear cell
PBS phosphate-buffered saline
PCR polymerase chain reaction
PEG polyethylene glycol
PEI polyethylenimine
QTL quantitative trait loci
RPMI media developed at Roswell Park Memorial Institute
RT-PCR polymerase chain reaction at room temperature
SNP single nucleotide polymorphism
TFA trifluoroacetic acid
TL1A TNF-like ligand 1A (TNFSF15)
TMB tetramethylbenzene
TNF tumor necrosis factor-α

SEQUENCE LISTING (2136 sequences)

SEQ ID NO: 1 - DNA, 324 bp, Homo sapiens
gatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgt

SEQ ID NO: 2 - protein, 107 aa, Homo sapiens [sequence omitted]

SEQ ID NO: 3 - DNA, 363 bp, Homo sapiens
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagt

SEQ ID NO: 4 - protein, 121 aa, Homo sapiens [sequence omitted]

SEQ ID NO: 5 - DNA, 324 bp, Homo sapiens
gacatccagatgacccagtctccatcctccctgtctgcatctgtaggagacagagtcaccatcacttgccggacaagtcaggacattagagatgatttaggctggtatcagcagaaaccagggaaagcccctaagcgcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggaaatcaaacga

SEQ ID NO: 6 - protein, 107 aa, Homo sapiens
DIQMTQSPSSLSASVGDRVTITCRTSQDIRDDLGWYQQKPGKAPKRLIYDASSLQSGVPSRFSGSGSGTEFTLTISSLQPEDFATYYCLQHNSYPPTFGQGTKVEIK

SEQ ID NO: 7 - DNA, 369 bp, Homo sapiens
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagtcatatcatatgatggaaataataaactctatacagactccgtgaagggccgattcaccatctccagagacgattccaagagcacgctgtatctgcaaatgaacagcctgagagctgaggacacggctgtgtattactgtgcgagagatccaacagtaactctctactactactacggtatggacgtctggggccaagggaccacggtcaccgtctcctca

SEQ ID NO: 8 - protein, 123 aa, Homo sapiens
QVQLVESGGGVVQPGRSLRLSCAASGFTFSSYGMHWVRQAPGKGLEWVAVISYDGNNKLYTDSVKGRFTISRDDSKSTLYLQMNSLRAEDTAVYYCARDPTVTLYYYYGMDVWGQGTTVTVSS

SEQ ID NO: 9 - DNA, 324 bp, Homo sapiens
gacatccagatgacccagtctccatcctccctatctgcatctgtaggagacagagtcaccatcacttgccgggcaagtcagagcattaacaactatttaaattggtatcagcagaaaccagggatagcccctaagctcctgatctatgctacatccagtttgcaaagtggggtcccatcaaggttcagtggcagtggatctgggacagatttctctctcaccatcagcagtctgcaacctgaagattttgcaacttacttctgtcaacagagttacagtacccctcggacgttcggccaagggaccaaggtggagatcaaacga

SEQ ID NO: 10 - protein, 107 aa, Homo sapiens
DIQMTQSPSSLSASVGDRVTITCRASQSINNYLNWYQQKPGIAPKLLIYATSSLQSGVPSRFSGSGSGTDFSLTISSLQPEDFATYFCQQSYSTPRTFGQGTKVEIK

SEQ ID NO: 11 - DNA, 354 bp, Homo sapiens
caggtgcagctgcaggagtcgggcccaggactggtgaagccttcggagaccctgtccctcacctgcactgtctctggtggctccatcagtagttacttctggagctggatccggcagcccccagggaagggactggagtggattgggtatatctattacagtgggagcaccaactacaacccctccctcaagagtcgagtcaccatgtcaatagacacgtccaagaaccagttctccctgaagctgagctctgtgaccgctgcggacacggccgtgtattactgtgcgagagaaattgggagctactacggctttgactactggggccagggagccctggtcaccgtctcctca

SEQ ID NO: 12 - protein, 118 aa, Homo sapiens
QVQLQESGPGLVKPSETLSLTCTVSGGSISSYFWSWIRQPPGKGLEWIGYIYYSGSTNYNPSLKSRVTMSIDTSKNQFSLKLSSVTAADTAVYYCAREIGSYYGFDYWGQGALVTVSS

SEQ ID NO: 13 - DNA, 324 bp, Homo sapiens
gacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctggagattttgcaacttactactgtcaacagagttacagtacccctcggacgttcggccaagggaccaagctggaaatcaaacga

SEQ ID NO: 14 - protein, 107 aa, Homo sapiens
DIQMTQSPSSLSASVGDRVTITCRASQSINNYLNWYQQRPGKAPKLLIYAASSLQSGVPSRFSGSGSGTDFTLTISSLQPGDFATYYCQQSYSTPRTFGQGTKLEIK

SEQ ID NO: 15 - DNA, 354 bp, Homo sapiens
caggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggaacaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctca

SEQ ID NO: 16 - protein, 118 aa, Homo sapiens
QVQLQESGPGLVKPSETLSLTCTVSGGSISSYFWSWIRQPPGKGLEWIGYIYYSGNTKYNPSLKSRVTISIDTSKNQFSLKLSSVTAADTAVYYCARETGSYYGFDYWGQGTLVTVSS

SEQ ID NO: 17 - DNA, 342 bp, Homo sapiens
gacatcgtgatgacccagtctccagactccctggctgtgtctctgggcgagagggccaccatcaattgcaagtccagccagagtgtgttatacagctccaacaataagaactacttagtttggtaccagcagaaaccaggacagcctcctaaactgctcatttactgggcatctacccgggaatccggggtccctgatcgattcagtggcagcgggtctgggacagatttcactctcaccatcagcagcctgcaggctgaagatgtggcagtttattactgtcagcaatattataagactcctctcactttcggcggagggaccaaggtggagatcaaacga

SEQ ID NO: 18 - protein, 113 aa, Homo sapiens
DIVMTQSPDSLAVSLGERATINCKSSQSVLYSSNNKNYLVWYQQKPGQPPKLLIYWASTRESGVPDRFSGSGSGTDFTLTISSLQAEDVAVYYCQQYYKTPLTFGGGTKVEIK

SEQ ID NO: 19 - DNA, 375 bp, Homo sapiens
caggtacagttgcagcagtcaggtccaggactggtgaagccctcgcagaccctctcactcacctgtgtcatctccggggacagtgtctctaccaacagtgttgcttggaactggatcaggcagtccccatcgagaggccttgagtggctgggaaggacatactacaggtccaagtggtataatgattatgcagtttctgtgaaaagtcgaataaccatcaacccagacacatccaagaaccagttctccctgcagctgaactctgtgactcccgaggacacggctgtgtattactgtgcaagagaggatggggatagctactaccgctacggtatggacgtctggggccaagggaccacggtcaccgtctcctca

SEQ ID NO: 20 - protein, 125 aa, Homo sapiens
QVQLQQSGPGLVKPSQTLSLTCVISGDSVSTNSVAWNWIRQSPSRGLEWLGRTYYRSKWYNDYAVSVKSRITINPDTSKNQFSLQLNSVTPEDTAVYYCAREDGDSYYRYGMDVWGQGTTVTVSS

SEQ ID NO: 21 - DNA, 324 bp, Homo sapiens
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacga

SEQ ID NO: 22 - protein, 107 aa, Homo sapiens
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIK

SEQ ID NO: 23 - DNA, 360 bp, Homo sapiens
caggtgcagttacagcagtggggcgcaggactgttgaagccttcggagaccctgtccctcacctgcgctgtccatggtgggtccttcagtggttactactggaactggatccgccagcccccagggaaggggctggagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctggtcaccgtctcctca

SEQ ID NO: 24 - protein, 120 aa, Homo sapiens
QVQLQQWGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSS

SEQ ID NO: 25 - DNA, 342 bp, Homo sapiens
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacga

SEQ ID NO: 26 - protein, 113 aa, Homo sapiens
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIK

SEQ ID NO: 27 - DNA, 375 bp, Homo sapiens
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctca

SEQ ID NO: 28 - protein, 125 aa, Homo sapiens
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSS

SEQ ID NO: 29 - DNA, 342 bp, Homo sapiens
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatttcgcaacttattactgtcagcaatattataagactcctctcactttcggcggagggaccaaggtggagatcaaacga

SEQ ID NO: 30 - protein, 113 aa, Homo sapiens
DIQMTQSPSSLSASVGDRVTITCRSSQSVLYSSNNKNYLVWYQQKPGKVPKLLIYWASTRESGVPSRFSGSGSGTDFTLTISSLQPEDFATYYCQQYYKTPLTFGGGTKVEIK

SEQ ID NO: 31 - DNA, 375 bp, Homo sapiens
gaggtacagttgctggagtcaggtggaggactggtgcagcccggggggagcctccgactcagctgtgccatctccggggacagtgtctctaccaacagtgttgcttggaactggatcaggcaggccccagggaaaggccttgagtgggtgagcaggacatactacaggtccaagtggtataatgattatgcagtttctgtgaaaggtcgattcaccatcagcccagacacatccaagaacacgttctacctgcagatgaactctctgagagccgaggacacggctgtgtattactgtgcaagagaggatggggatagctactaccgctacggtatggacgtctggggccaagggaccacggtcaccgtctcctca

SEQ ID NO: 32 - protein, 125 aa, Homo sapiens
EVQLLESGGGLVQPGGSLRLSCAISGDSVSTNSVAWNWIRQAPGKGLEWVSRTYYRSKWYNDYAVSVKGRFTISPDTSKNTFYLQMNSLRAEDTAVYYCAREDGDSYYRYGMDVWGQGTTVTVSS

SEQ ID NO: 33 - DNA, 324 bp, Homo sapiens
gacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgt

SEQ ID NO: 34 - protein, 107 aa, Homo sapiens
DIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGGGTKVEIK

SEQ ID NO: 35 - DNA, 372 bp, Homo sapiens
caggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagt

SEQ ID NO: 36 - protein, 124 aa, Homo sapiens
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSS

SEQ ID NO: 37 - DNA, 336 bp, Homo sapiens
cagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggt

SEQ ID NO: 38 - protein, 111 aa, Homo sapiens
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVL

SEQ ID NO: 39 - DNA, 348 bp, Homo sapiens
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagt

SEQ ID NO: 40 - protein, 116 aa, Homo sapiens
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSS

SEQ ID NO: 41 - DNA, 324 bp, Homo sapiens
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtcagggtactaaagtagaaatcaaacgt

SEQ ID NO: 42 - protein, 107 aa, Homo sapiens
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIK

SEQ ID NO: 43 - DNA, 354 bp, Homo sapiens
gaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatgggttggattaatacttacattggagagcctatttatgctgacagcgtcaagggcagattcacgttctctctagacacatccaagtcaacagcatacctccaaatgaatagcctgagagcagaggacaccgcagtgtactattgtgctagaggatacagatcttatgccatggactactggggccagggtaccctagtcacagtctcctca

SEQ ID NO: 44 - protein, 118 aa, Homo sapiens
EVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSS

SEQ ID NO: 45 - DNA, 708 bp, Homo sapiens
atggacatgagagtgcctgcacagctgctgggcctgctgctgctgtggctgagaggcgccagatgcgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 46 - protein, 214 aa, Homo sapiens
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - DNA, 1419 bp, Homo sapiens
atggacatgagagtgcctgcacagctgctgggcctgctgctgctgtggctgagaggcgccagatgcgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 48 - protein, 451 aa, Homo sapiens
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - DNA, 708 bp, Homo sapiens
atggacatgagagtgcctgcacagctgctgggcctgctgctgctgtggctgagaggcgccagatgcgacatccagatgacccagtctccatcctccctgtctgcatctgtaggagacagagtcaccatcacttgccggacaagtcaggacattagagatgatttaggctggtatcagcagaaaccagggaaagcccctaagcgcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 50 - protein, 214 aa, Homo sapiens
DIQMTQSPSSLSASVGDRVTITCRTSQDIRDDLGWYQQKPGKAPKRLIYDASSLQSGVPSRFSGSGSGTEFTLTISSLQPEDFATYYCLQHNSYPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 51 - DNA, 1425 bp, Homo sapiens
atggacatgagagtgcctgcacagctgctgggcctgctgctgctgtggctgagaggcgccagatgccaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagtcatatcatatgatggaaataataaactctatacagactccgtgaagggccgattcaccatctccagagacgattccaagagcacgctgtatctgcaaatgaacagcctgagagctgaggacacggctgtgtattactgtgcgagagatccaacagtaactctctactactactacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 52 - protein, 453 aa, Homo sapiens
QVQLVESGGGVVQPGRSLRLSCAASGFTFSSYGMHWVRQAPGKGLEWVAVISYDGNNKLYTDSVKGRFTISRDDSKSTLYLQMNSLRAEDTAVYYCARDPTVTLYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - DNA, 708 bp, Homo sapiens
atggacatgagagtgcctgcacagctgctgggcctgctgctgctgtggctgagaggcgccagatgcgacatccagatgacccagtctccatcctccctatctgcatctgtaggagacagagtcaccatcacttgccgggcaagtcagagcattaacaactatttaaattggtatcagcagaaaccagggatagcccctaagctcctgatctatgctacatccagtttgcaaagtggggtcccatcaaggttcagtggcagtggatctgggacagatttctctctcaccatcagcagtctgcaacctgaagattttgcaacttacttctgtcaacagagttacagtacccctcggacgttcggccaagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 54 - protein, 214 aa, Homo sapiens
DIQMTQSPSSLSASVGDRVTITCRASQSINNYLNWYQQKPGIAPKLLIYATSSLQSGVPSRFSGSGSGTDFSLTISSLQPEDFATYFCQQSYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 55 - DNA, 1401 bp, Homo sapiens
atgaaacatctgtggttcttcctgctgctggtggcggcgccgcgctgggtgctgagccaggtgcagctgcaggagtcgggcccaggactggtgaagccttcggagaccctgtccctcacctgcactgtctctggtggctccatcagtagttacttctggagctggatccggcagcccccagggaagggactggagtggattgggtatatctattacagtgggagcaccaactacaacccctccctcaagagtcgagtcaccatgtcaatagacacgtccaagaaccagttctccctgaagctgagctctgtgaccgctgcggacacggccgtgtattactgtgcgagagaaattgggagctactacggctttgactactggggccagggagccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 56 - protein, 448 aa, Homo sapiens
QVQLQESGPGLVKPSETLSLTCTVSGGSISSYFWSWIRQPPGKGLEWIGYIYYSGSTNYNPSLKSRVTMSIDTSKNQFSLKLSSVTAADTAVYYCAREIGSYYGFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - DNA, 708 bp, Homo sapiens
atggacatgagagtgcctgcacagctgctgggcctgctgctgctgtggctgagaggcgccagatgcgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctggagattttgcaacttactactgtcaacagagttacagtacccctcggacgttcggccaagggaccaagctggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 58 - protein, 214 aa, Homo sapiens
DIQMTQSPSSLSASVGDRVTITCRASQSINNYLNWYQQRPGKAPKLLIYAASSLQSGVPSRFSGSGSGTDFTLTISSLQPGDFATYYCQQSYSTPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - DNA, 1344 bp, Homo sapiens
caggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggaacaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 60 - protein, 448 aa, Homo sapiens
QVQLQESGPGLVKPSETLSLTCTVSGGSISSYFWSWIRQPPGKGLEWIGYIYYSGNTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - DNA, 720 bp, Homo sapiens
atggtgttgcagacccaggtcttcatttctctgttgctctggatctctggtgcctacggggacatcgtgatgacccagtctccagactccctggctgtgtctctgggcgagagggccaccatcaattgcaagtccagccagagtgtgttatacagctccaacaataagaactacttagtttggtaccagcagaaaccaggacagcctcctaaactgctcatttactgggcatctacccgggaatccggggtccctgatcgattcagtggcagcgggtctgggacagatttcactctcaccatcagcagcctgcaggctgaagatgtggcagtttattactgtcagcaatattataagactcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 62 - protein, 240 aa, Homo sapiens
MVLQTQVFISLLLWISGAYGDIVMTQSPDSLAVSLGERATINCKSSQSVLYSSNNKNYLVWYQQKPGQPPKLLIYWASTRESGVPDRFSGSGSGTDFTLTISSLQAEDVAVYYCQQYYKTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 63 - DNA, 1431 bp, Homo sapiens
atggacatgagagtgcctgcacagctgctgggcctgctgctgctgtggctgagaggcgccagatgccaggtacagttgcagcagtcaggtccaggactggtgaagccctcgcagaccctctcactcacctgtgtcatctccggggacagtgtctctaccaacagtgttgcttggaactggatcaggcagtccccatcgagaggccttgagtggctgggaaggacatactacaggtccaagtggtataatgattatgcagtttctgtgaaaagtcgaataaccatcaacccagacacatccaagaaccagttctccctgcagctgaactctgtgactcccgaggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 64 - protein, 455 aa, Homo sapiens
QVQLQQSGPGLVKPSQTLSLTCVISGDSVSTNSVAWNWIRQSPSRGLEWLGRTYYRSKWYNDYAVSVKSRITINPDTSKNQFSLQLNSVTPEDTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - DNA, 642 bp, Homo sapiens
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 66 - protein, 214 aa, Homo sapiens
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - DNA, 1350 bp, Homo sapiens
caggtgcagttacagcagtggggcgcaggactgttgaagccttcggagaccctgtccctcacctgcgctgtccatggtgggtccttcagtggttactactggaactggatccgccagcccccagggaaggggctggagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 68 - protein, 450 aa, Homo sapiens
QVQLQQWGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - DNA, 726 bp, Homo sapiens
atggacatgagagtgcctgcacagctgctgggcctgctgctgctgtggctgagaggcgccagatgcgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 70 - protein, 220 aa, Homo sapiens
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - DNA, 1365 bp, Homo sapiens
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 72 - protein, 455 aa, Homo sapiens
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - DNA, 726 bp, Homo sapiens
atggacatgagggtgccggcccagctcctcggtcttctgttgctctggctccgtggtgcccgctgtgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatttcgcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 74 - protein, 220 aa, Homo sapiens
DIQMTQSPSSLSASVGDRVTITCRSSQSVLYSSNNKNYLVWYQQKPGKVPKLLIYWASTRESGVPSRFSGSGSGTDFTLTISSLQPEDFATYYCQQYYKTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 75 - DNA, 1431 bp, Homo sapiens
atggacatgagagtgcctgcacagctgctgggcctgctgctgctgtggctgagaggcgccagatgcgaggtacagttgctggagtcaggtggaggactggtgcagcccggggggagcctccgactcagctgtgccatctccggggacagtgtctctaccaacagtgttgcttggaactggatcaggcaggccccagggaaaggccttgagtgggtgagcaggacatactacaggtccaagtggtataatgattatgcagtttctgtgaaaggtcgattcaccatcagcccagacacatccaagaacacgttctacctgcagatgaactctctgagagccgaggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 76 - protein, 455 aa, Homo sapiens
EVQLLESGGGLVQPGGSLRLSCAISGDSVSTNSVAWNWIRQAPGKGLEWVSRTYYRSKWYNDYAVSVKGRFTISPDTSKNTFYLQMNSLRAEDTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - DNA, 708 bp, Homo sapiens
atggacatgagggtgcccgctcagctcctggggctcctgctgctgtggctgagaggtgcgcgctgtgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 78 - protein, 214 aa, Homo sapiens
DIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 79 - DNA, 1428 bp, Homo sapiens
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 80 - protein, 454 aa, Homo sapiens
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - DNA, 2166 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacga

SEQ ID NO: 82 - protein, 700 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKR

SEQ ID NO: 83 - DNA, 717 bp, Homo sapiens
atggacatgagggtgcccgctcagctcctggggctcctgctgctgtggctgagaggtgcgcgctgtcagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 84 - protein, 217 aa, Homo sapiens
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 85 - DNA, 1404 bp, Homo sapiens
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 86 - protein, 446 aa, Homo sapiens
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - DNA, 642 bp, Homo sapiens
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcaccagtaacaaaaagctttaatagaggagagtgt

SEQ ID NO: 88 - protein, 214 aa, Homo sapiens
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - DNA, 1434 bp, Homo sapiens
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatgggttggattaatacttacattggagagcctatttatgctgacagcgtcaagggcagattcacgttctctctagacacatccaagtcaacagcatacctccaaatgaatagcctgagagcagaggacaccgcagtgtactattgtgctagaggatacagatcttatgccatggactactggggccagggtaccctagtcacagtctcctcagcttccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtcgacaagaaagttgagcccaaatcttgtgacaaaactcacacatgcgccgcggacgaagtggatggctgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 90 - protein, 456 aa, Homo sapiens
EVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAADEVDGCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - DNA, 33 bp, Homo sapiens
cgcgcgtcccagggaatccggaattacctcgca

SEQ ID NO: 92 - protein, 11 aa, Homo sapiens
RASQGIRNYLA

SEQ ID NO: 93 - DNA, 21 bp, Homo sapiens
gccgcctcgactcttcagagt

SEQ ID NO: 94 - DNA, 36 bp, Artificial Sequence
  Synthetic oligonucleotide
agggccagtcagagtgttagaagcagttacttagcc

SEQ ID NO: 95 - DNA, 27 bp, Homo sapiens
cagagatacaaccgagcgccttacaca

SEQ ID NO: 96 - protein, 9 aa, Homo sapiens
QRYNRAPYT

SEQ ID NO: 97 - DNA, 33 bp, Homo sapiens
cggacaagtcaggacattagagatgatttaggc

SEQ ID NO: 98 - protein, 11 aa, Homo sapiens
RTSQDIRDDLG

SEQ ID NO: 99 - DNA, 21 bp, Homo sapiens
gatgcatccagtttgcaaagt

SEQ ID NO: 100 - protein, 7 aa, Homo sapiens
DASSLQS

SEQ ID NO: 101 - DNA, 27 bp, Homo sapiens
ctacagcataatagttaccctccgacg

SEQ ID NO: 102 - protein, 9 aa, Homo sapiens
LQHNSYPPT

SEQ ID NO: 103 - DNA, 33 bp, Homo sapiens
cgggcaagtcagagcattaacaactatttaaat

SEQ ID NO: 104 - DNA, 24 bp, Artificial Sequence
  Synthetic oligonucleotide
cagcagtatggtagctcacctacc

SEQ ID NO: 105 - DNA, 21 bp, Homo sapiens
gctacatccagtttgcaaagt

SEQ ID NO: 106 - protein, 7 aa, Homo sapiens
ATSSLQS

SEQ ID NO: 107 - DNA, 27 bp, Homo sapiens
caacagagttacagtacccctcggacg

SEQ ID NO: 108 - protein, 9 aa, Homo sapiens
QQSYSTPRT

SEQ ID NO: 109 - DNA, 33 bp, Homo sapiens; identical to SEQ ID NO: 103

SEQ ID NO: 110 - protein, 11 aa, Homo sapiens
RASQSINNYLN

SEQ ID NO: 111 - DNA, 21 bp, Homo sapiens
gctgcatccagtttgcaaagt

SEQ ID NO: 112 - protein, 7 aa, Homo sapiens
AASSLQS

SEQ ID NO: 113 - DNA, 27 bp, Homo sapiens
caacagagttacagtacccctcggacg

SEQ ID NO: 114 - protein, 16 aa, Artificial Sequence
  Synthetic polypeptide
  MISC_FEATURE (2)..(2): Xaa may independently be M, G, A, V, I, or L
  MISC_FEATURE (4)..(4): Xaa may be A, C, D, E, F, I, K, L, M, N, P, Q, R, V, W, or Y
  MISC_FEATURE (6)..(7): Xaa may independently be M, G, A, V, I, or L
  MISC_FEATURE (14)..(14): Xaa may independently be M, G, A, V, I, or L
EXNXSXXTNYNPSXKS

SEQ ID NO: 115 - DNA, 51 bp, Homo sapiens
aagtccagccagagtgtgttatacagctccaacaataagaactacttagtt

SEQ ID NO: 116 - protein, 17 aa, Homo sapiens
KSSQSVLYSSNNKNYLV

SEQ ID NO: 117 - DNA, 21 bp, Homo sapiens
tgggcatctacccgggaatcc

SEQ ID NO: 118 - protein, 7 aa, Homo sapiens
WASTRES

SEQ ID NO: 119 - DNA, 27 bp, Homo sapiens
cagcaatattataagactcctctcact

SEQ ID NO: 120 - protein, 9 aa, Homo sapiens
QQYYKTPLT

SEQ ID NO: 121 - DNA, 36 bp, Homo sapiens; identical to SEQ ID NO: 94

SEQ ID NO: 122 - protein, 12 aa, Homo sapiens
RASQSVRSSYLA

SEQ ID NO: 123 - DNA, 21 bp, Homo sapiens
ggtgcatccagcagggccact

SEQ ID NO: 124 - protein, 7 aa, Homo sapiens
GASSRAT

SEQ ID NO: 125 - DNA, 24 bp, Homo sapiens
cagcagtatggtagctcacctacc

SEQ ID NO: 126 - protein, 8 aa, Homo sapiens
QQYGSSPT

SEQ ID NO: 127 - DNA, 51 bp, Homo sapiens
aggtccagccagagtgtgttatacagctccaacaataagaactacttagtt

SEQ ID NO: 128 - protein, 17 aa, Homo sapiens
RSSQSVLYSSNNKNYLV

SEQ ID NO: 129 - DNA, 1350 bp, Artificial Sequence
  Synthetic polynucleotide
caggtgcagttacagcagtggggcgcaggactgttgaagccttcggagaccctgtccctcacctgcgctgtccatggtgggtccttcagtggttactactggaactggatccgccagccaccagggaaggggctagagtggattggggaaatcaatcatgctggaatcaccaactacaacccgtccctcaagagtcgagtcaccatatcattagacacgtccaagaaccagttctccctgaagctgacctctgtgaccgccgcggacacggctgtgtattactgtgcgagaggatattgtagaagtaccacctgctactttgactactggggccagggaaccctagtcaccgtctccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 130 - protein, 469 aa, Artificial Sequence
  Synthetic polypeptide
MKHLWFFLLLVAAPRWVLSQVQLQQWGAGLLKPSETLSLTCAVHGGSFSGYYWNWIRQPPGKGLEWIGEINHAGITNYNPSLKSRVTISLDTSKNQFSLKLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 131 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 132 - protein, 236 aa, Artificial Sequence
  Synthetic polypeptide
MDMRVPAQLLGLLLLWLRGARCDIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 133 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 134 - protein, 234 aa, Artificial Sequence
  Synthetic polypeptide
METPAQLLFLLLLWLPDTTGEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 135 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatgggttggattaatacttacattggagagcctatttatgctgacagcgtcaagggcagattcacgttctctctagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 136 - protein, 470 aa, Artificial Sequence
  Synthetic polypeptide
MDMRVPAQLLGLLLLWLRGARCEVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 137 - DNA, 1344 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccagggaagggactggagtggattgggtatatctattacagtgggagcaccaactacaacccctccctcaagagtcgagtcaccatgtcaatagacacgtccaagaaccagttctccctgaagctgagctctgtgaccgctgcggacacggccgtgtattactgtgcgagagaaattgggagctactacggctttgactactggggccagggaaccctggtcaccgtctccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 138 - protein, 467 aa, Artificial Sequence
  Synthetic polypeptide
MKHLWFFLLLVAAPRWVLSQVQLQESGPGLVKPSETLSLTCTVSGGSISSYFWSWIRQPPGKGLEWIGYIYYSGSTNYNPSLKSRVTMSIDTSKNQFSLKLSSVTAADTAVYYCAREIGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 139 - DNA, 33 bp, Homo sapiens
cgggcaagtcaggacatcagaaatgatttaggc

SEQ ID NO: 140 - protein, 11 aa, Homo sapiens
RASQDIRNDLG

SEQ ID NO: 141 - DNA, 21 bp, Homo sapiens
gctgcgtccagtttgcaaagt

SEQ ID NO: 142 - protein, 11 aa, Homo sapiens
AAWDDSLNGVV

SEQ ID NO: 143 - DNA, 27 bp, Homo sapiens
ctacaacataatagttatccgctcact

SEQ ID NO: 144 - protein, 9 aa, Homo sapiens
LQHNSYPLT

SEQ ID NO: 145 - DNA, 42 bp, Homo sapiens
actgggagcagttccaacatcggggcaggttatgatgtacac

SEQ ID NO: 146 - protein, 14 aa, Homo sapiens
TGSSSNIGAGYDVH

SEQ ID NO: 147 - DNA, 21 bp, Homo sapiens
ggtaacagcaatcggccctca

SEQ ID NO: 148 - protein, 7 aa, Homo sapiens
GNSNRPS

SEQ ID NO: 149 - DNA, 33 bp, Homo sapiens
cagtcctatgacagcagcctgagtggttcggtg

SEQ ID NO: 150 - protein, 11 aa, Homo sapiens
QSYDSSLSGSV

SEQ ID NO: 151 - DNA, 33 bp, Homo sapiens
aaagccagtcagaacgtaggtactaacgtagcc

SEQ ID NO: 152 - protein, 11 aa, Homo sapiens
KASQNVGTNVA

SEQ ID NO: 153 - DNA, 21 bp, Homo sapiens
agtgcctctttcctctatagt

SEQ ID NO: 154 - protein, 7 aa, Homo sapiens
SASFLYS

SEQ ID NO: 155 - DNA, 27 bp, Homo sapiens
caacagtataacatctacccactcaca

SEQ ID NO: 156 - protein, 9 aa, Homo sapiens
QQYNIYPLT

SEQ ID NO: 157 - DNA, 15 bp, Homo sapiens
gattatgcgatgcat

SEQ ID NO: 158 - protein, 5 aa, Homo sapiens
DYAMH

SEQ ID NO: 159 - DNA, 51 bp, Homo sapiens
gccattacgtggaatagcggacacatcgattatgcagacagtgtggagggc

SEQ ID NO: 160 - protein, 17 aa, Homo sapiens
AITWNSGHIDYADSVEG

SEQ ID NO: 161 - DNA, 36 bp, Homo sapiens
gtctcctacttgtctacagcttcgtcgctcgactat

SEQ ID NO: 162 - protein, 12 aa, Homo sapiens
VSYLSTASSLDY

SEQ ID NO: 163 - DNA, 15 bp, Homo sapiens
agctatggcatgcac

SEQ ID NO: 164 - protein, 5 aa, Homo sapiens
SYGMH

SEQ ID NO: 165 - DNA, 51 bp, Homo sapiens
gtcatatcatatgatggaaataataaactctatacagactccgtgaagggc

SEQ ID NO: 166 - protein, 17 aa, Homo sapiens
VISYDGNNKLYTDSVKG

SEQ ID NO: 167 - DNA, 39 bp, Homo sapiens
ccaacagtaactctctactactactacggtatggacgtc

SEQ ID NO: 168 - protein, 13 aa, Homo sapiens
PTVTLYYYYGMDV

SEQ ID NO: 169 - DNA, 15 bp, Homo sapiens
agttacttctggagc

SEQ ID NO: 170 - protein, 5 aa, Homo sapiens
SYFWS

SEQ ID NO: 171 - DNA, 48 bp, Homo sapiens
tatatctattacagtgggagcaccaactacaacccctccctcaagagt

SEQ ID NO: 172 - protein, 16 aa, Homo sapiens
YIYYSGSTNYNPSLKS

SEQ ID NO: 173 - DNA, 30 bp, Homo sapiens
gaaattgggagctactacggctttgactac

SEQ ID NO: 174 - protein, 10 aa, Homo sapiens
EIGSYYGFDY

SEQ ID NO: 175 - DNA, 15 bp, Homo sapiens
agttacttctggagc

SEQ ID NO: 176 - protein, 214 aa, Artificial Sequence
  Synthetic polypeptide
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLESTLELSKADYEKHKVYACEVTHQGLSSPVTKSFNRGEC

SEQ ID NO: 177 - DNA, 48 bp, Homo sapiens
tatatctattacagtgggaacaccaaatacaacccctccctcaagagt

SEQ ID NO: 178 - protein, 16 aa, Homo sapiens
YIYYSGNTKYNPSLKS

SEQ ID NO: 179 - DNA, 30 bp, Homo sapiens
gaaactgggagctactacggctttgactac

SEQ ID NO: 180 - protein, 10 aa, Homo sapiens
ETGSYYGFDY

SEQ ID NO: 181 - DNA, 21 bp, Homo sapiens
accaacagtgttgcttggaac

SEQ ID NO: 182 - protein, 7 aa, Homo sapiens
TNSVAWN

SEQ ID NO: 183 - DNA, 54 bp, Homo sapiens
aggacatactacaggtccaagtggtataatgattatgcagtttctgtgaaaagt

SEQ ID NO: 184 - protein, 18 aa, Homo sapiens
RTYYRSKWYNDYAVSVKS

SEQ ID NO: 185 - DNA, 39 bp, Homo sapiens
gaggatggggatagctactaccgctacggtatggacgtc

SEQ ID NO: 186 - protein, 13 aa, Homo sapiens
EDGDSYYRYGMDV

SEQ ID NO: 187 - DNA, 15 bp, Homo sapiens
ggttactactggaac

SEQ ID NO: 188 - protein, 5 aa, Homo sapiens
GYYWN

SEQ ID NO: 189 - DNA, 48 bp, Homo sapiens
gaaatcaatcatgctggaaacaccaactacaacccgtccctcaagagt

SEQ ID NO: 190 - protein, 16 aa, Homo sapiens
EINHAGNTNYNPSLKS

SEQ ID NO: 191 - DNA, 36 bp, Homo sapiens
ggatattgtagaagtaccacctgctactttgactac

SEQ ID NO: 192 - protein, 12 aa, Homo sapiens
GYCRSTTCYFDY

SEQ ID NO: 193 - DNA, 21 bp, Homo sapiens
accaacagtgttgcttggaac

SEQ ID NO: 194 - protein, 214 aa, Artificial Sequence
  Synthetic polypeptide
EIVLTQSPGTLSLSPGERATLSCRASQSVRSSYLAWYQKKPGQAPRLLIYGASSRATGIPDRFSGSGSGTDFTLTISRLEPEDFAVYYCQQYGSSPTFGQGTRLEIKRTVAAPSVFIFPPSDEQLKSGTAKVVCLLNNFYPREAKVQWKVDNALQSGNSQESVTEQDSKDSTYSLKSTLTLSKADYEKHKVYACEVTHQGLSSPVTKSFNRGEC

SEQ ID NO: 195 - DNA, 54 bp, Homo sapiens
aggacatactacaggtccaagtggtataatgattatgcagtttctctgaaaagt

SEQ ID NO: 196 - protein, 18 aa, Homo sapiens
RTYYRSKWYNDYAVSLKS

SEQ ID NO: 197 - DNA, 39 bp, Homo sapiens; identical to SEQ ID NO: 185

SEQ ID NO: 198 - protein, 450 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVEDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 199 - DNA, 21 bp, Homo sapiens
accaacagtgttgcttggaac

SEQ ID NO: 200 - protein, 7 aa, Homo sapiens
TNSVAWN

SEQ ID NO: 201 - DNA, 54 bp, Homo sapiens
aggacatactacaggtccaagtggtataatgattatgcagtttctgtgaaaggt

SEQ ID NO: 202 - protein, 18 aa, Homo sapiens
RTYYRSKWYNDYAVSVKG

SEQ ID NO: 203 - DNA, 39 bp, Homo sapiens; identical to SEQ ID NO: 185

SEQ ID NO: 204 - protein, 17 aa, Artificial Sequence
  Synthetic polypeptide
  MISC_FEATURE: Each Xaa is independently M, G, A, V, I, or L
  misc_feature (6)..(6): Xaa can be any naturally occurring amino acid
  misc_feature (14)..(14): Xaa can be any naturally occurring amino acid
VISYDXNNKLYTDXVKG

SEQ ID NO: 205 - DNA, 15 bp, Homo sapiens
agctatgacatgcac

SEQ ID NO: 206 - protein, 5 aa, Homo sapiens
SYDMH

SEQ ID NO: 207 - DNA, 51 bp, Homo sapiens
gttatatcatatgatggaagtattaaatactatgcagactccgtgaagggc

SEQ ID NO: 208 - protein, 17 aa, Homo sapiens
VISYDGSIKYYADSVKG

SEQ ID NO: 209 - DNA, 45 bp, Homo sapiens
gaggtccgtagtgggagctactactattactacagtatggacgtc

SEQ ID NO: 210 - protein, 15 aa, Homo sapiens
EVRSGSYYYYYSMDV

SEQ ID NO: 211 - DNA, 15 bp, Homo sapiens
agctactggatcggc

SEQ ID NO: 212 - protein, 5 aa, Homo sapiens
SYWIG

SEQ ID NO: 213 - DNA, 51 bp, Homo sapiens
atcatctatcttggtgactcagataccagatacagcccgtccttccaaggc

SEQ ID NO: 214 - protein, 17 aa, Homo sapiens
IIYLGDSDTRYSPSFQG

SEQ ID NO: 215 - DNA, 21 bp, Homo sapiens
agtaactggggtcttgactac

SEQ ID NO: 216 - protein, 7 aa, Homo sapiens
SNWGLDY

SEQ ID NO: 217 - DNA, 15 bp, Homo sapiens
gactatggaatgaat

SEQ ID NO: 218 - protein, 5 aa, Homo sapiens
DYGMN

SEQ ID NO: 219 - DNA, 51 bp, Homo sapiens
tggattaatacttacattggagagcctatttatgctgacagcgtcaagggc

SEQ ID NO: 220 - protein, 17 aa, Homo sapiens
WINTYIGEPIYADSVKG

SEQ ID NO: 221 - DNA, 27 bp, Homo sapiens
ggatacagatcttatgccatggactac

SEQ ID NO: 222 - protein, 9 aa, Homo sapiens
GYRSYAMDY

SEQ ID NO: 223 - protein, 11 aa, Homo sapiens
RASQGISNYLA

SEQ ID NO: 224 - protein, 7 aa, Homo sapiens
AASTLQS

SEQ ID NO: 225 - protein, 9 aa, Homo sapiens
QKYNSAPWT

SEQ ID NO: 226 - protein, 11 aa, Homo sapiens
RASQGIRNDLG

SEQ ID NO: 227 - protein, 16 aa, Artificial Sequence
  Synthetic polypeptide
EIQHSGITNYNPSLKS

SEQ ID NO: 228 - protein, 9 aa, Homo sapiens
LQHNSYPWT

SEQ ID NO: 229 - protein, 11 aa, Homo sapiens
RASQSISSYLN

SEQ ID NO: 230 - protein, 15 aa, Artificial Sequence
  Synthetic polypeptide
  MISC_FEATURE (1)..(1): Each Xaa is independently selected from M, G, A, V, I and L.
  MISC_FEATURE (5)..(6): Each Xaa is independently selected from M, G, A, V, I and L.
  MISC_FEATURE (13)..(13): Each Xaa is independently selected from M, G, A, V, I and L.
XQHSXXTNYNPSXKS

SEQ ID NO: 231 - protein, 9 aa, Homo sapiens
QQSYSTPWT

SEQ ID NO: 232 - protein, 11 aa, Homo sapiens
RASQSISSYLN

SEQ ID NO: 233 - protein, 9 aa, Artificial Sequence
  Synthetic polypeptide
  MISC_FEATURE (1)..(1): Each Xaa is independently selected from M, G, A, V, I and L.
XQHNSYPPT

SEQ ID NO: 234 - protein, 9 aa, Homo sapiens
QQSYSTPYT

SEQ ID NO: 235 - protein, 17 aa, Homo sapiens
KSSQSVLYSSNNKNYLA

SEQ ID NO: 236 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctatctgcatctgtaggagacagagtcaccatcacttgccgggcaagtcagagcattaacaactatttaaattggtatcagcagaaaccagggaaagcccctaagctcctgatctatgctacatccagtttgcaaagtggggtcccatcaaggttcagtggcagtggatctgggacagatttctctctcaccatcagcagtctgcaacctgaagattttgcaacttacttctgtcaacagagttacagtacccctcggacgttcggccaagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 237 - protein, 9 aa, Homo sapiens
QQYYSTPLT

SEQ ID NO: 238 - protein, 12 aa, Homo sapiens
RASQSVSSSYLA

SEQ ID NO: 239 - protein, 236 aa, Artificial Sequence
  Synthetic polypeptide
MDMRVPAQLLGLLLLWLRGARCDIQMTQSPSSLSASVGDRVTITCRASQSINNYLNWYQQKPGKAPKLLIYATSSLQSGVPSRFSGSGSGTDFSLTISSLQPEDFATYFCQQSYSTPRTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 240 - protein, 9 aa, Homo sapiens
QQYGSSPIT

SEQ ID NO: 241 - protein, 11 aa, Homo sapiens
RASQGISNYLA

SEQ ID NO: 242 - protein, 7 aa, Homo sapiens
AASTLQS

SEQ ID NO: 243 - protein, 9 aa, Homo sapiens
QKYNSAPLT

SEQ ID NO: 244 - protein, 11 aa, Homo sapiens
RASQGIRNDLG

SEQ ID NO: 245 - protein, 7 aa, Homo sapiens
AASSLQS

SEQ ID NO: 246 - protein, 9 aa, Homo sapiens
LQHNSYPLT

SEQ ID NO: 247 - protein, 14 aa, Homo sapiens
TGSSSNIGAGYDVH

SEQ ID NO: 248 - protein, 7 aa, Homo sapiens
GNSNRPS

SEQ ID NO: 249 - protein, 11 aa, Homo sapiens
QSYDSSLSGVV

SEQ ID NO: 250 - DNA, 1365 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 251 - protein, 17 aa, Homo sapiens
GISWNSGSIGYADSVKG

SEQ ID NO: 252 - protein, 8 aa, Homo sapiens
  misc_feature (2)..(2): Xaa can be any naturally occurring amino acid
VXQLVYFD

SEQ ID NO: 253 - protein, 455 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 254 - protein, 17 aa, Homo sapiens
VISYDGSNKYYADSVKG

SEQ ID NO: 255 - protein, 12 aa, Homo sapiens
TTVTYYYYYGMD

SEQ ID NO: 256 - protein, 5 aa, Homo sapiens
SYYWS

SEQ ID NO: 257 - DNA, 726 bp, Artificial Sequence
  Synthetic polynucleotide
atggacatgagagtgcctgcacagctgctgggcctgctgctgctgtggctgagaggcgccagatgcgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 258 - protein, 9 aa, Homo sapiens
YSGSYYYFD

SEQ ID NO: 259 - protein, 5 aa, Homo sapiens
SYYWS

SEQ ID NO: 260 - protein, 16 aa, Homo sapiens
YIYYSGSTNYNPSLKS

SEQ ID NO: 261 - protein, 6 aa, Homo sapiens
LTGYFD

SEQ ID NO: 262 - protein, 7 aa, Homo sapiens
SNSAAWN

SEQ ID NO: 263 - DNA, 33 bp, Artificial Sequence; identical to SEQ ID NO: 103
  Synthetic oligonucleotide

SEQ ID NO: 264 - protein, 14 aa, Homo sapiens
RDGYNYYYYYYGMD

SEQ ID NO: 265 - protein, 5 aa, Homo sapiens
GYYWS

SEQ ID NO: 266 - protein, 16 aa, Homo sapiens
EINHSGSTNYNPSLKS

SEQ ID NO: 267 - protein, 13 aa, Homo sapiens
GYCSSTSCYTYFD

SEQ ID NO: 268 - protein, 7 aa, Homo sapiens
SGSYYWS

SEQ ID NO: 269 - protein, 16 aa, Homo sapiens
YIYYSGSTNYNPSLKS

SEQ ID NO: 270 - protein, 14 aa, Homo sapiens
RDGYNYYYYYYGMD

SEQ ID NO: 271 - protein, 5 aa, Homo sapiens
SNYMS

SEQ ID NO: 272 - protein, 16 aa, Homo sapiens
VIYSGGSTYYADSVKG

SEQ ID NO: 273 - protein, 14 aa, Homo sapiens
RDGYNYYYYYYGMD

SEQ ID NO: 274 - protein, 5 aa, Homo sapiens
SYAMH

SEQ ID NO: 275 - protein, 17 aa, Homo sapiens
VISYDGSNKYYADSVKG

SEQ ID NO: 276 - protein, 14 aa, Homo sapiens
EYSSSSYYYYYGMD

SEQ ID NO: 277 - protein, 5 aa, Homo sapiens
SYWIG

SEQ ID NO: 278 - protein, 17 aa, Homo sapiens
IIYPGDSDTRYSPSFQG

SEQ ID NO: 279 - protein, 9 aa, Homo sapiens
YNWNDNWFD

SEQ ID NO: 280 - protein, 5 aa, Homo sapiens
SNYMS

SEQ ID NO: 281 - protein, 16 aa, Homo sapiens
VIYSGGSTYYADSVKG

SEQ ID NO: 282 - protein, 10 aa, Homo sapiens
GYSSSWYYFD

SEQ ID NO: 283 - DNA, 2205 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaggaggcggaggatctggtggcggtggttctggcggcggaggctccgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacga

SEQ ID NO: 284 - protein, 713 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSGGGGSGGGGSGGGGSDIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKR

SEQ ID NO: 285 - DNA, 2166 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagtgtctggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggctgtgggaccaagctggaaatcaaacga

SEQ ID NO: 286 - protein, 700 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKCLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGCGTKLEIKR

SEQ ID NO: 287 - DNA, 324 bp, Artificial Sequence; identical to SEQ ID NO: 21
  Synthetic polynucleotide

SEQ ID NO: 288 - protein, 107 aa, Artificial Sequence; identical to SEQ ID NO: 22
  Synthetic polypeptide

SEQ ID NO: 289 - DNA, 360 bp, Artificial Sequence
  Synthetic polynucleotide
caggtgcagttacagcagtggggcgcaggactgttgaagccttcggagaccctgtccctcacctgcgctgtccatggtgggtccttcagtggttactactggaactggatccgccagccaccagggaaggggctagagtggattggggaaatcaatcatgctggaatcaccaactacaacccgtccctcaagagtcgagtcaccatatcattagacacgtccaagaaccagttctccctgaagctgacctctgtgaccgccgcggacacggctgtgtattactgtgcgagaggatattgtagaagtaccacctgctactttgactactggggccagggaaccctagtcaccgtctccagt

SEQ ID NO: 290 - protein, 120 aa, Artificial Sequence
  Synthetic polypeptide
QVQLQQWGAGLLKPSETLSLTCAVHGGSFSGYYWNWIRQPPGKGLEWIGEINHAGITNYNPSLKSRVTISLDTSKNQFSLKLTSVTAADTAVYYCARGYCRSTTCYFDYWGQGTLVTVSS

SEQ ID NO: 291 - DNA, 324 bp, Artificial Sequence
  Synthetic polynucleotide
gacatccagatgacccagtctccatcctccctatctgcatctgtaggagacagagtcaccatcacttgccgggcaagtcagagcattaacaactatttaaattggtatcagcagaaaccagggaaagcccctaagctcctgatctatgctacatccagtttgcaaagtggggtcccatcaaggttcagtggcagtggatctgggacagatttctctctcaccatcagcagtctgcaacctgaagattttgcaacttacttctgtcaacagagttacagtacccctcggacgttcggccaagggaccaaggtggagatcaaacga

SEQ ID NO: 292 - protein, 107 aa, Artificial Sequence
  Synthetic polypeptide
DIQMTQSPSSLSASVGDRVTITCRASQSINNYLNWYQQKPGKAPKLLIYATSSLQSGVPSRFSGSGSGTDFSLTISSLQPEDFATYFCQQSYSTPRTFGQGTKVEIK

SEQ ID NO: 293 - DNA, 354 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccagggaagggactggagtggattgggtatatctattacagtgggagcaccaactacaacccctccctcaagagtcgagtcaccatgtcaatagacacgtccaagaaccagttctccctgaagctgagctctgtgaccgctgcggacacggccgtgtattactgtgcgagagaaattgggagctactacggctttgactactggggccagggaaccctggtcaccgtctccagt

SEQ ID NO: 294 - protein, 118 aa, Artificial Sequence
  Synthetic polypeptide
QVQLQESGPGLVKPSETLSLTCTVSGGSISSYFWSWIRQPPGKGLEWIGYIYYSGSTNYNPSLKSRVTMSIDTSKNQFSLKLSSVTAADTAVYYCAREIGSYYGFDYWGQGTLVTVSS

SEQ ID NO: 295 - DNA, 342 bp, Artificial Sequence; identical to SEQ ID NO: 25
  Synthetic polynucleotide

SEQ ID NO: 296 - protein, 113 aa, Artificial Sequence; identical to SEQ ID NO: 26
  Synthetic polypeptide

SEQ ID NO: 297 - DNA, 375 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctccagt

SEQ ID NO: 298 - protein, 125 aa, Artificial Sequence; identical to SEQ ID NO: 28
  Synthetic polypeptide

SEQ ID NO: 299 - DNA, 342 bp, Artificial Sequence; identical to SEQ ID NO: 29
  Synthetic polynucleotide

SEQ ID NO: 300 - protein, 113 aa, Artificial Sequence; identical to SEQ ID NO: 30
  Synthetic polypeptide

SEQ ID NO: 301 - DNA, 375 bp, Artificial Sequence
  Synthetic polynucleotide
gaggtacagttgctggagtcaggtggaggactggtgcagcccggggggagcctccgactcagctgtgccatctccggggacagtgtctctaccaacagtgttgcttggaactggatcaggcaggccccagggaaaggccttgagtgggtgagcaggacatactacaggtccaagtggtataatgattatgcagtttctgtgaaaggtcgattcaccatcagcccagacacatccaagaacacgttctacctgcagatgaactctctgagagccgaggacacggctgtgtattactgtgcaagagaggatggggatagctactaccgctacggtatggacgtctggggccaagggaccacggtcaccgtctccagt

SEQ ID NO: 302 - protein, 125 aa, Artificial Sequence; identical to SEQ ID NO: 32
  Synthetic polypeptide

SEQ ID NO: 303 - DNA, 324 bp, Artificial Sequence
  Synthetic polynucleotide
gacatccagatgacccagtctccatcctccctgtctgcatctgtaggagacagagtcaccatcacttgccggacaagtcaggacattagagatgatttaggctggtatcagcagaaaccagggaaagcccctaagctcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggaaatcaaacga

SEQ ID NO: 304 - protein, 107 aa, Artificial Sequence
  Synthetic polypeptide
DIQMTQSPSSLSASVGDRVTITCRTSQDIRDDLGWYQQKPGKAPKLLIYDASSLQSGVPSRFSGSGSGTEFTLTISSLQPEDFATYYCLQHNSYPPTFGQGTKVEIK

SEQ ID NO: 305 - DNA, 369 bp, Artificial Sequence
  Synthetic polynucleotide
caggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagtcatatcatatgatggaaataataaactctatacagactccgtgaagggccgattcaccatctccagagacgattccaagagcacgctgtatctgcaaatgaacagcctgagagctgaggacacggctgtgtattactgtgcgagagatccaacagtaactctctactactactacggtatggacgtctggggccaagggaccacggtcaccgtctccagt

SEQ ID NO: 306 - protein, 123 aa, Artificial Sequence; identical to SEQ ID NO: 8
  Synthetic polypeptide

SEQ ID NO: 307 - DNA, 324 bp, Artificial Sequence; identical to SEQ ID NO: 5
  Synthetic polynucleotide

SEQ ID NO: 308 - protein, 107 aa, Artificial Sequence; identical to SEQ ID NO: 6
  Synthetic polypeptide

SEQ ID NO: 309 - DNA, 369 bp, Artificial Sequence; identical to SEQ ID NO: 305
  Synthetic polynucleotide

SEQ ID NO: 310 - protein, 123 aa, Artificial Sequence; identical to SEQ ID NO: 8
  Synthetic polypeptide

SEQ ID NO: 311 - DNA, 2205 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaatgccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaggaggcggaggatctggtggcggtggttctggcggcggaggctccgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggctgtgggaccaaggtggagatcaaacga

SEQ ID NO: 312 - protein, 713 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKCLEWIGRTYYRSKWYNDYAVSLKSRVTISPDTSKNQFSLKLSSVTAADTAVYYCAREDGDSYYRYGMDVWGQGTTVTVSSGGGGSGGGGSGGGGSDIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGCGTKVEIKR

SEQ ID NO: 313 - DNA, 2151 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacga

SEQ ID NO: 314 - protein, 695 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKR

SEQ ID NO: 315 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatgggttggattaatacttacattggagagcctatttatgctgacagcgtcaagggcagattcacgatctctctagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 316 - protein, 470 aa, Artificial Sequence
  Synthetic polypeptide
MDMRVPAQLLGLLLLWLRGARCEVQLVESGGGLVQPGGSLRLSCAASGYVFTDYGMNWVRQAPGKGLEWMGWINTYIGEPIYADSVKGRFTISLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 317 - protein, 5 aa, Homo sapiens
SYAMH

SEQ ID NO: 318 - protein, 215 aa, Homo sapiens
MDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 319 - DNA, 2190 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaggaggcggaggatctggtggcggtggttctggcggcggaggctccgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacga

SEQ ID NO: 320 - protein, 708 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSGGGGSGGGGSGGGGSDIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKR

SEQ ID NO: 321 - DNA, 2151 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagtgtctggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggctgtgggaccaagctggaaatcaaacga

SEQ ID NO: 322 - protein, 695 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKCLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGCGTKLEIKR

SEQ ID NO: 323 - protein, 242 aa, Artificial Sequence
  Synthetic polypeptide
MDMRVPAQLLGLLLLWLRGARCDIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 324 - DNA, 1431 bp, Artificial Sequence
  Synthetic polynucleotide
atggacatgagagtgcctgcacagctgctgggcctgctgctgctgtggctgagaggcgccagatgcgaggtacagttgctggagtcaggtggaggactggtgcagcccggggggagcctccgactcagctgtgccatctccggggacagtgtctctaccaacagtgttgcttggaactggatcaggcaggccccagggaaaggccttgagtgggtgagcaggacatactacaggtccaagtggtataatgattatgcagtttctgtgaaaggtcgattcaccatcagcccagacacatccaagaacacgttctacctgcagatgaactctctgagagccgaggacacggctgtgtattactgtgcaagagaggatggggatagctactaccgctacggtatggacgtctggggccaagggaccacggtcaccgtctccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 325 - protein, 477 aa, Artificial Sequence
  Synthetic polypeptide
MDMRVPAQLLGLLLLWLRGARCEVQLLESGGGLVQPGGSLRLSCAISGDSVSTNSVAWNWIRQAPGKGLEWVSRTYYRSKWYNDYAVSVKGRFTISPDTSKNTFYLQMNSLRAEDTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 326 - DNA, 726 bp, Artificial Sequence
  Synthetic polynucleotide
atggacatgagggtgccggcccagctcctcggtcttctgttgctctggctccgtggtgcccgctgtgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatttcgcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 327 - protein, 242 aa, Artificial Sequence
  Synthetic polypeptide
MDMRVPAQLLGLLLLWLRGARCDIQMTQSPSSLSASVGDRVTITCRSSQSVLYSSNNKNYLVWYQQKPGKVPKLLIYWASTRESGVPSRFSGSGSGTDFTLTISSLQPEDFATYYCQQYYKTPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 328 - DNA, 1425 bp, Artificial Sequence
  Synthetic polynucleotide
atggacatgagagtgcctgcacagctgctgggcctgctgctgctgtggctgagaggcgccagatgccaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagtcatatcatatgatggaaataataaactctatacagactccgtgaagggccgattcaccatctccagagacgattccaagagcacgctgtatctgcaaatgaacagcctgagagctgaggacacggctgtgtattactgtgcgagagatccaacagtaactctctactactactacggtatggacgtctggggccaagggaccacggtcaccgtctccagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 329 - protein, 475 aa, Artificial Sequence
  Synthetic polypeptide
MDMRVPAQLLGLLLLWLRGARCQVQLVESGGGVVQPGRSLRLSCAASGFTFSSYGMHWVRQAPGKGLEWVAVISYDGNNKLYTDSVKGRFTISRDDSKSTLYLQMNSLRAEDTAVYYCARDPTVTLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 330 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctgtctgcatctgtaggagacagagtcaccatcacttgccggacaagtcaggacattagagatgatttaggctggtatcagcagaaaccagggaaagcccctaagctcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 331 - protein, 236 aa, Artificial Sequence
  Synthetic polypeptide
MDMRVPAQLLGLLLLWLRGARCDIQMTQSPSSLSASVGDRVTITCRTSQDIRDDLGWYQQKPGKAPKLLIYDASSLQSGVPSRFSGSGSGTEFTLTISSLQPEDFATYYCLQHNSYPPTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 332 - DNA, 1425 bp, Artificial Sequence; identical to SEQ ID NO: 328
  Synthetic polynucleotide

SEQ ID NO: 333 - protein, 214 aa, Artificial Sequence
  Synthetic polypeptide
DIQMTQSPSSLSASVGDRVTITCKASQNVGTNVAWYQQKPGKAPKALIYSASFLYSGVPSRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 334 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctgtctgcatctgtaggagacagagtcaccatcacttgccggacaagtcaggacattagagatgatttaggctggtatcagcagaaaccagggaaagcccctaagcgcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 335 - protein, 236 aa, Artificial Sequence
  Synthetic polypeptide
MDMRVPAQLLGLLLLWLRGARCDIQMTQSPSSLSASVGDRVTITCRTSQDIRDDLGWYQQKPGKAPKRLIYDASSLQSGVPSRFSGSGSGTEFTLTISSLQPEDFATYYCLQHNSYPPTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 336 - DNA, 717 bp, Artificial Sequence
  Synthetic polynucleotide
atggacatgagggtgcccgctcagctcctggggctcctgctgctgtggctgagaggtgcgcgctgtcagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccgagagctatctgagcctgacgcctgagcagtggaagtcccacagaagctacagctgccaggtcacgcatgaagggagcaccgtggagaagacagtggcccctacagaatgttca

SEQ ID NO: 337 - protein, 239 aa, Artificial Sequence
  Synthetic polypeptide
MDMRVPAQLLGLLLLWLRGARCQSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 338 - DNA, 1404 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 339 - protein, 468 aa, Artificial Sequence
  Synthetic polypeptide
MDMRVPAQLLGLLLLWLRGARCEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 340 - DNA, 708 bp, Artificial Sequence
  Synthetic polynucleotide
atggacatgagggtgcccgctcagctcctggggctcctgctgctgtggctgagaggtgcgcgctgtgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 341 - protein, 236 aa, Artificial Sequence
  Synthetic polypeptide
MDMRVPAQLLGLLLLWLRGARCDIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 342 - DNA, 1428 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 343 - protein, 476 aa, Artificial Sequence
  Synthetic polypeptide
MDMRVPAQLLGLLLLWLRGARCQVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 344 - DNA, 2190 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaatgccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaggaggcggaggatctggtggcggtggttctggcggcggaggctccgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggctgtgggaccaaggtggagatcaaacga

SEQ ID NO: 345 - protein, 708 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKCLEWIGRTYYRSKWYNDYAVSLKSRVTISPDTSKNQFSLKLSSVTAADTAVYYCAREDGDSYYRYGMDVWGQGTTVTVSSGGGGSGGGGSGGGGSDIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGCGTKVEIKR

SEQ ID NO: 346 - DNA, 2175 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacga

SEQ ID NO: 347 - protein, 703 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKR

SEQ ID NO: 348 - DNA, 2214 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaggaggcggaggatctggtggcggtggttctggcggcggaggctccgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacga

SEQ ID NO: 349 - protein, 716 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSGGGGSGGGGSGGGGSDIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKR

SEQ ID NO: 350 - DNA, 2175 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagtgtctggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggctgtgggaccaagctggaaatcaaacga

SEQ ID NO: 351 - protein, 703 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKCLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGCGTKLEIKR

SEQ ID NO: 352 - DNA, 2214 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaatgccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaggaggcggaggatctggtggcggtggttctggcggcggaggctccgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggctgtgggaccaaggtggagatcaaacga

SEQ ID NO: 353 - protein, 716 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKCLEWIGRTYYRSKWYNDYAVSLKSRVTISPDTSKNQFSLKLSSVTAADTAVYYCAREDGDSYYRYGMDVWGQGTTVTVSSGGGGSGGGGSGGGGSDIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGCGTKVEIKR

SEQ ID NO: 354 - DNA, 2166 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgt

SEQ ID NO: 355 - protein, 700 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR

SEQ ID NO: 356 - DNA, 2163 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggt

SEQ ID NO: 357 - protein, 699 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLG

SEQ ID NO: 358 - DNA, 2175 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgt

SEQ ID NO: 359 - protein, 703 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSGGGGSGGGGSGGGGSDIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGGGTKVEIKR

SEQ ID NO: 360 - DNA, 2166 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaatgtctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggatgtgggacaaaagtcgagatcaagcgt

SEQ ID NO: 361 - protein, 700 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKCLEWVSAITWNSGHIDYADSVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGCGTKVEIKR

SEQ ID NO: 362 - DNA, 2163 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaatgcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggctgtgggaccaagctgaccgtcctaggt

SEQ ID NO: 363 - protein, 699 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKCLEWMGIIYLGDSDTRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGCGTKLTVLG

SEQ ID NO: 364 - DNA, 2175 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaagtgtctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggctgtgggaccaaggtggagatcaaacgt

SEQ ID NO: 365 - protein, 703 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKCLEWVAVISYDGSIKYYADSVKGRFTISRDNSKNTLYLQVNSLRAEDTAVYYCAREVRSGSYYYYYSMDVWGQGTTVTVSSGGGGSGGGGSGGGGSDIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGCGTKVEIKR

SEQ ID NO: 366 - DNA, 2187 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgt

SEQ ID NO: 367 - protein, 707 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR

SEQ ID NO: 368 - DNA, 2184 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggt

SEQ ID NO: 369 - protein, 706 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLG

SEQ ID NO: 370 - DNA, 2196 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgt

SEQ ID NO: 371 - protein, 710 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSGGGGSGGGGSGGGGSDIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGGGTKVEIKR

SEQ ID NO: 372 - DNA, 2187 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaatgtctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggatgtgggacaaaagtcgagatcaagcgt

SEQ ID NO: 373 - protein, 707 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKCLEWVSAITWNSGHIDYADSVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGCGTKVEIKR

SEQ ID NO: 374 - DNA, 2184 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaatgcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggctgtgggaccaagctgaccgtcctaggt

SEQ ID NO: 375 - protein, 706 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKCLEWMGIIYLGDSDTRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGCGTKLTVLG

SEQ ID NO: 376 - DNA, 2196 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaagtgtctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggctgtgggaccaaggtggagatcaaacgt

SEQ ID NO: 377 - protein, 710 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKCLEWVAVISYDGSIKYYADSVKGRFTISRDNSKNTLYLQVNSLRAEDTAVYYCAREVRSGSYYYYYSMDVWGQGTTVTVSSGGGGSGGGGSGGGGSDIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGCGTKVEIKR

SEQ ID NO: 378 - DNA, 2172 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacga

SEQ ID NO: 379 - protein, 702 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKR

SEQ ID NO: 380 - DNA, 2172 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaagtgtctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggctgtgggacacgactggagattaaacga

SEQ ID NO: 381 - protein, 702 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKCLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGCGTRLEIKR

SEQ ID NO: 382 - DNA, 2157 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacga

SEQ ID NO: 383 - protein, 697 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKR

SEQ ID NO: 384 - DNA, 2157 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaagtgtctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggctgtgggacacgactggagattaaacga

SEQ ID NO: 385 - protein, 697 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKCLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGCGTRLEIKR

SEQ ID NO: 386 - DNA, 2181 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacga

SEQ ID NO: 387 - protein, 705 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKR

SEQ ID NO: 388 - DNA, 2181 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaagtgtctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggctgtgggacacgactggagattaaacga

SEQ ID NO: 389 - protein, 705 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKCLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGCGTRLEIKR

SEQ ID NO: 390 - DNA, 2172 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgt

SEQ ID NO: 391 - protein, 702 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKR

SEQ ID NO: 392 - DNA, 2169 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggt

SEQ ID NO: 393 - protein, 701 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLG

SEQ ID NO: 394 - DNA, 2181 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgt

SEQ ID NO: 395 - protein, 705 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSGGGGSGGGGSGGGGSDIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGGGTKVEIKR

SEQ ID NO: 396 - DNA, 2172 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaatgtctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggatgtgggacaaaagtcgagatcaagcgt

SEQ ID NO: 397 - protein, 702 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKCLEWVSAITWNSGHIDYADSVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGCGTKVEIKR

SEQ ID NO: 398 - DNA, 2169 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaatgcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggctgtgggaccaagctgaccgtcctaggt

SEQ ID NO: 399 - protein, 701 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKCLEWMGIIYLGDSDTRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGCGTKLTVLG

SEQ ID NO: 400 - DNA, 2181 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaagtgtctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggctgtgggaccaaggtggagatcaaacgt

SEQ ID NO: 401 - protein, 705 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKCLEWVAVISYDGSIKYYADSVKGRFTISRDNSKNTLYLQVNSLRAEDTAVYYCAREVRSGSYYYYYSMDVWGQGTTVTVSSGGGGSGGGGSGGGGSDIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGCGTKVEIKR

SEQ ID NO: 402 - DNA, 2169 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaaggcttctggatacagctttaccagctactggatcggctgggtgcgccagatgcccgggaaaggcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgaaagcagcctgagtggttcggtgttcggcggagggaccaagctgaccgtcctaggt

SEQ ID NO: 403 - protein, 701 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKASGYSFTSYWIGWVRQMPGKGLEWMGIIYLGESETRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYESSLSGSVFGGGTKLTVLG

SEQ ID NO: 404 - DNA, 2169 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaaggcttctgaatacagctttaccagctactggatcggctgggtgcgccagatgcccgggaaaggcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgaaagcagcctgagtggttcggtgttcggcggagggaccaagctgaccgtcctaggt

SEQ ID NO: 405 - protein, 701 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKASEYSFTSYWIGWVRQMPGKGLEWMGIIYLGESETRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYESSLSGSVFGGGTKLTVLG

SEQ ID NO: 406 - DNA, 2163 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaaggcttctggatacagctttaccagctactggatcggctgggtgcgccagatgcccgggaaaggcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgaaagcagcctgagtggttcggtgttcggcggagggaccaagctgaccgtcctaggt

SEQ ID NO: 407 - protein, 699 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKASGYSFTSYWIGWVRQMPGKGLEWMGIIYLGESETRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYESSLSGSVFGGGTKLTVLG

SEQ ID NO: 408 - DNA, 2163 bp, Artificial Sequence
  Synthetic polynucleotide
atggacatgagggtgcccgctcagctcctggggctcctgctgctgtggctgagaggtgcgcgctgtcaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaaggcttctgaatacagctttaccagctactggatcggctgggtgcgccagatgcccgggaaaggcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgaaagcagcctgagtggttcggtgttcggcggagggaccaagctgaccgtcctaggt

SEQ ID NO: 409 - protein, 699 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKASEYSFTSYWIGWVRQMPGKGLEWMGIIYLGESETRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYESSLSGSVFGGGTKLTVLG

SEQ ID NO: 410 - DNA, 2169 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaaggcttctggatacagctttaccagctactggatcggctgggtgcgccagatgcccgggaaatgcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgaaagcagcctgagtggttcggtgttcggctgtgggaccaagctgaccgtcctaggt

SEQ ID NO: 411 - protein, 701 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKASGYSFTSYWIGWVRQMPGKCLEWMGIIYLGESETRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYESSLSGSVFGCGTKLTVLG

SEQ ID NO: 412 - DNA, 2169 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaaggcttctgaatacagctttaccagctactggatcggctgggtgcgccagatgcccgggaaatgcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtggaggcggaggatctggtggcggtggttctggcggcggaggctcccagtctgtgctgacgcagccgccctcagtgtctggggccccagggcagagggtcaccatctcctgcactgggagcagttccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgaaagcagcctgagtggttcggtgttcggctgtgggaccaagctgaccgtcctaggt

SEQ ID NO: 413 - protein, 701 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKASEYSFTSYWIGWVRQMPGKCLEWMGIIYLGESETRYSPSFQGQVTISADKSISTAYLQWSSLKASDTAMYYCARSNWGLDYWGQGTLVTVSSGGGGSGGGGSGGGGSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYESSLSGSVFGCGTKLTVLG

SEQ ID NO: 414 - DNA, 2181 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagctcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgt

SEQ ID NO: 415 - protein, 705 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTLVTVSSGGGGSGGGGSGGGGSDIQMTQSPSSLSASVGDRVTITCRASQDIRNDLGWYQQKPGKAPKLLIYAASSLQSGVPSRFSGSGSGPEFTLTISSLQPEDFATYYCLQHNSYPLTFGGGTKVEIKR

SEQ ID NO: 416 - DNA, 2181 bp, Artificial Sequence
  Synthetic polynucleotide
atggacatgagggtgcccgctcagctcctggggctcctgctgctgtggctgagaggtgcgcgctgtcaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatgcaagtattaaatactatgcagaatccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtggaggcggaggatctggtggcggtggttctggcggcggaggctccgacatccagatgacccagtctccatcctccctgtctgcatctgtaggagacagagtcaccatcacttgccgggcaagtcaggacatcagaaatgatttaggctggtatcagcagaaaccagggaaagcccctaagctcctgatctatgctgcgtccagtttgcaaagtggggtcccatcaaggttcagcggcagtggatctgggacagaattcactctcacaatcagcagcctgcagcctgaagattttgcaacttattactgtctacaacataatagttatccgctcactttcggcggagggaccaaggtggagatcaaacgt

SEQ ID NO: 417 - protein, 705 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLVESGGGVVQPGRSLRLSCAASGFTFSSYDMHWVRQAPGKGLEWVAVISYDASIKYYAESVKGRFTISRDNSKNTLYLQVNSLRAEDTAVYYCAREVRSGSYYYYYSMDVWGQGTLVTVSSGGGGSGGGGSGGGGSDIQMTQSPSSLSASVGDRVTITCRASQDIRNDLGWYQQKPGKAPKLLIYAASSLQSGVPSRFSGSGSGTEFTLTISSLQPEDFATYYCLQHNSYPLTFGGGTKVEIKR

SEQ ID NO: 418 - DNA, 2187 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcagtgattatgcgatgcattgggtccggcaagcgcctggaaaagggctcgagtgggtttccgccattacgtggaatagcggacacatcgattatgcagacgctgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatttcgctacctattactgccagagatacaaccgagcgccttacacattcggacaagggacaaaagtcgagatcaagcgt

SEQ ID NO: 419 - protein, 707 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFSDYAMHWVRQAPGKGLEWVSAITWNSGHIDYADAVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDFATYYCQRYNRAPYTFGQGTKVEIKR

SEQ ID NO: 420 - DNA, 2187 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcagtgattatgcgatgcattgggtccggcaagcgcctggaaaagggctcgagtgggtttccgccattacgtggaatagcggacacatcgattatgcagaaagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatttcgctacctattactgccagagatacaaccgagcgccttacacattcggacaagggacaaaagtcgagatcaagcgt

SEQ ID NO: 421 - protein, 707 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFSDYAMHWVRQAPGKGLEWVSAITWNSGHIDYAESVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDFATYYCQRYNRAPYTFGQGTKVEIKR

SEQ ID NO: 422 - DNA, 2187 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcagtgattatgcgatgcattgggtccggcaagcgcctggaaaatgtctcgagtgggtttccgccattacgtggaatagcggacacatcgattatgcagacgctgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatttcgctacctattactgccagagatacaaccgagcgccttacacattcggatgtgggacaaaagtcgagatcaagcgt

SEQ ID NO: 423 - protein, 707 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFSDYAMHWVRQAPGKCLEWVSAITWNSGHIDYADAVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDFATYYCQRYNRAPYTFGCGTKVEIKR

SEQ ID NO: 424 - DNA, 2187 bp, Artificial Sequence
  Synthetic polynucleotide
atggacatgagggtgcccgctcagctcctggggctcctgctgctgtggctgagaggtgcgcgctgtcaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcagtgattatgcgatgcattgggtccggcaagcgcctggaaaatgtctcgagtgggtttccgccattacgtggaatagcggacacatcgattatgcagaaagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtggaggcggaggatctggtggcggtggttctggcggcggaggctccgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatttcgctacctattactgccagagatacaaccgagcgccttacacattcggatgtgggacaaaagtcgagatcaagcgt

SEQ ID NO: 425 - protein, 707 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFSDYAMHWVRQAPGKCLEWVSAITWNSGHIDYAESVEGRFTISRDNAKNSLYLQMNSLRAEDTAVYYCAKVSYLSTASSLDYWGQGTLVTVSSGGGGSGGGGSGGGGSDIQMTQSPSSLSASVGDRVTITCRASQGIRNYLAWYQQKPGKAPKLLIYAASTLQSGVPSRFSGSGSGTDFTLTISSLQPEDFATYYCQRYNRAPYTFGCGTKVEIKR

SEQ ID NO: 426 - DNA, 2151 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaaggcttctggatacagctttaccagctactggatcggctgggtgcgccagatgcccgggaaaggcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacga

SEQ ID NO: 427 - protein, 695 aa, Artificial Sequence
  Synthetic polypeptide
EVQLVQSGAEVKKPGESLKISCKASGYSFTSYWIGWVRQMPGKGLEWMGIIYLGESETRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKR

SEQ ID NO: 428 - DNA, 2151 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaaggcttctgaatacagctttaccagctactggatcggctgggtgcgccagatgcccgggaaaggcctggagtggatggggatcatctatcttggtgaatcagaaaccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacga

SEQ ID NO: 429 - protein, 695 aa, Artificial Sequence
  Synthetic polypeptide
EVQLVQSGAEVKKPGESLKISCKASEYSFTSYWIGWVRQMPGKGLEWMGIIYLGESETRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKR

SEQ ID NO: 430 - DNA, 2175 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccaagggaccttggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacga

SEQ ID NO: 431 - protein, 703 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKR

SEQ ID NO: 432 - DNA, 2175 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagtgtctggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggctgtgggaccaagctggaaatcaaacga

SEQ ID NO: 433 - protein, 703 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKCLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGCGTKLEIKR

SEQ ID NO: 434 - DNA, 2181 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacga

SEQ ID NO: 435 - protein, 705 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKR

SEQ ID NO: 436 - DNA, 2181 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaagtgtctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggctgtgggacacgactggagattaaacga

SEQ ID NO: 437 - protein, 705 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKCLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGCGTRLEIKR

SEQ ID NO: 438 - DNA, 2166 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcagtgattatgcgatgcattgggtccggcaagcgcctggaaaagggctcgagtgggtttccgccattacgtggaatagcggacacatcgattatgcagacgctgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacga

SEQ ID NO: 439 - protein, 700 aa, Artificial Sequence
  Synthetic polypeptide
EVQLVESGGGLVQPGRSLRLSCAASGFTFSDYAMHWVRQAPGKGLEWVSAITWNSGHIDYADAVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKR

SEQ ID NO: 440 - DNA, 2166 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcagtgattatgcgatgcattgggtccggcaagcgcctggaaaagggctcgagtgggtttccgccattacgtggaatagcggacacatcgattatgcagacgctgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggatccggcagcccccaggtaagtgtctggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaggaggcggaggatctggtggcggtggttctggcggcggaggctccgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggctgtgggaccaagctggaaatcaaacga

SEQ ID NO: 441 - protein, 700 aa, Artificial Sequence
  Synthetic polypeptide
EVQLVESGGGLVQPGRSLRLSCAASGFTFSDYAMHWVRQAPGKGLEWVSAITWNSGHIDYADAVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKCLEWIGYIYYSGQTKYNPSLKSRVTISIDTSKNQFSLKLSSVTAADTAVYYCARETGSYYGFDYWGQGTLVTVSSGGGGSGGGGSGGGGSDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGCGTKLEIKR

SEQ ID NO: 442 - DNA, 2172 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcagtgattatgcgatgcattgggtccggcaagcgcctggaaaagggctcgagtgggtttccgccattacgtggaatagcggacacatcgattatgcagacgctgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacga

SEQ ID NO: 443 - protein, 702 aa, Artificial Sequence
  Synthetic polypeptide
EVQLVESGGGLVQPGRSLRLSCAASGFTFSDYAMHWVRQAPGKGLEWVSAITWNSGHIDYADAVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKR

SEQ ID NO: 444 - DNA, 2172 bp, Artificial Sequence
  Synthetic polynucleotide
atggacatgagggtgcccgctcagctcctggggctcctgctgctgtggctgagaggtgcgcgctgtgaggtacaactggtggaatcaggtggaggtttggtgcagccggggagatcgctcaggcttagctgtgcggcatcggggtttactttcagtgattatgcgatgcattgggtccggcaagcgcctggaaaagggctcgagtgggtttccgccattacgtggaatagcggacacatcgattatgcagacgctgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaagtgtctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaggaggcggaggatctggtggcggtggttctggcggcggaggctccgaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggctgtgggacacgactggagattaaacga

SEQ ID NO: 445 - protein, 702 aa, Artificial Sequence
  Synthetic polypeptide
EVQLVESGGGLVQPGRSLRLSCAASGFTFSDYAMHWVRQAPGKGLEWVSAITWNSGHIDYADAVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKCLEWIGEINHAGNTNYNPSLKSRVTISLDTSKNQFSLTLTSVTAADTAVYYCARGYCRSTTCYFDYWGQGTLVTVSSGGGGSGGGGSGGGGSEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGCGTRLEIKR

SEQ ID NO: 446 - DNA, 708 bp, Homo sapiens
atggacatgagagtgcctgcacagctgctgggcctgctgctgctgtggctgagaggcgccagatgcgacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 447 - protein, 236 aa, Homo sapiens
MDMRVPAQLLGLLLLWLRGARCDIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 448 - DNA, 717 bp, Homo sapiens
atggacatgagggtgcccgctcagctcctggggctcctgctgctgtggctgagaggtgcgcgctgtcagtctgtgctgacgcagccgccctcagtgtctggggccccagggcagagggtcaccatctcctgcactgggagcagttccaacatcggggcaggttatgatgtacactggtaccagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgaaagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 449 - protein, 217 aa, Homo sapiens
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYESSLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 450 - DNA, 708 bp, Homo sapiens
atggacatgagggtgcccgctcagctcctggggctcctgctgctgtggctgagaggtgcgcgctgtgacatccagatgacccagtctccatcctccctgtctgcatctgtaggagacagagtcaccatcacttgccgggcaagtcaggacatcagaaatgatttaggctggtatcagcagaaaccagggaaagcccctaagctcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 451 - protein, 214 aa, Homo sapiens
DIQMTQSPSSLSASVGDRVTITCRASQDIRNDLGWYQQKPGKAPKLLIYAASSLQSGVPSRFSGSGSGPEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 452 - DNA, 708 bp, Homo sapiens
atggacatgagggtgcccgctcagctcctggggctcctgctgctgtggctgagaggtgcgcgctgtgatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatttcgctacctattactgccagagatacaaccgagcgccttacacattcggacaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 453 - protein, 214 aa, Homo sapiens
DIQMTQSPSSLSASVGDRVTITCRASQGIRNYLAWYQQKPGKAPKLLIYAASTLQSGVPSRFSGSGSGTDFTLTISSLQPEDFATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 454 - DNA, 642 bp, Homo sapiens
gaaattgtgttgacgcagtctccaggcaccctgtctttgtctccaggggaaagagtcaccctctcctgcagggccagtcagagtgtaagaagcagctacttagcctggtaccagcagagagctggccaggctcccaggctcctcatctatggtgcatccagccgggccactggcatcccagacaggttcagtggcagtgggtctgggacagacttcactctcaccatcagcagactggagcctgaagattttgcagtgtattactgtcagcagtatggtagctctcctaccttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 455 - protein, 214 aa, Homo sapiens
EIVLTQSPGTLSLSPGERVTLSCRASQSVRSSYLAWYQQRAGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - DNA, 1350 bp, Homo sapiens
caggtgcagttacagcagtggggcgcaggactgttgaagccttcggagaccctgtccctcacctgcgatgtctatggtgggtccttcagtggttactactggaactggatccgccagcccccagggaaggggctggagtggattggggaaatcaatcatagtggaattaccaactacaacccgtccctcaagagtcgagtcaccatatcagtagacacgtccaagaaccagttctccctgaagctgagctctgtgaccgccgcggacacggctgtgtattactgtgcgagaggatattgtagaagtaccacctgctactttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 457 - protein, 450 aa, Homo sapiens
QVQLQQWGAGLLKPSETLSLTCDVYGGSFSGYYWNWIRQPPGKGLEWIGEINHSGITNYNPSLKSRVTISVDTSKNQFSLKLSSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - DNA, 708 bp, Homo sapiens
atggacatgagagtgcctgcacagctgctgggcctgctgctgctgtggctgagaggcgccagatgcgacatccagatgacccagtctccatcctccctgtctgcttctgtaggagacagagtcaccatcacttgccgggcaagtcagggcattagcaatgatttagcctggtatcagcagaaaccagggaaagcccctaagcgcctgatctttgctgcatccagtttgcaaagtggggtcccatcaaggttcagcggcagtggatctgggacagaattcactctcacaatcagcagcctgcagcctgaagattttgcaacttattactgtctccagcataatagttaccctcccactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 459 - protein, 214 aa, Homo sapiens
DIQMTQSPSSLSASVGDRVTITCRASQGISNDLAWYQQKPGKAPKRLIFAASSLQSGVPSRFSGSGSGTEFTLTISSLQPEDFATYYCLQHNSYPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 460 - DNA, 1425 bp, Homo sapiens
atggacatgagagtgcctgcacagctgctgggcctgctgctgctgtggctgagaggcgccagatgccaggtgcagctggtggagtctgggggaggcgtggtccagcctgggaggtccctgagactctcctgtgcagcctctggattcaccctcagtagctatggcatgcactgggtccgccaggctccaggcaaggggctggagtgggtggcagttatgtcatatgatggaaataataaattatatgcagactccgtgaagggccgattcaccatctccagagacaattccaagaaaacgctgtatctgcaaatgaacagcctgagagctgaggacacggctgtgtattactgtgcgagagacgaaactgaaaccctctactactactacggtattgacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacggcagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 461 - protein, 453 aa, Homo sapiens
QVQLVESGGGVVQPGRSLRLSCAASGFTLSSYGMHWVRQAPGKGLEWVAVMSYDGNNKLYADSVKGRFTISRDNSKKTLYLQMNSLRAEDTAVYYCARDETETLYYYYGIDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - DNA, 727 bp, Artificial Sequence
  Synthetic polynucleotide
atggacatgagagtgcctgcacagctgctgggcctgctgctgctgtggctgagaggcgccagatgcgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaacaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 463 - protein, 448 aa, Artificial Sequence
  Synthetic polypeptide
EVQLVESGGGLVQPGGSLRLSCAASGYTFTDYGMNWVRQAPGKGLEWMGWINTYIGEPIYADSVKGRFTISRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 464 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatccaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 465 - protein, 448 aa, Artificial Sequence
  Synthetic polypeptide
EVQLVESGGGLVQPGGSLRLSCAASGYVFTDYGMNWVRQAPGKGLEWMAWINTYIGEPIYADSVKGRFTISRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 466 - DNA, 36 bp, Homo sapiens
agggccagtcagagtgtaagaagcagctacttagcc

SEQ ID NO: 467 - DNA, 21 bp, Artificial Sequence
  Synthetic oligonucleotide
ggtgcatccagcagggccact

SEQ ID NO: 468 - DNA, 33 bp, Homo sapiens
cgggcaagtcagggcattagcaatgatttagcc

SEQ ID NO: 469 - protein, 11 aa, Homo sapiens
RASQGISNDLA

SEQ ID NO: 470 - DNA, 21 bp, Homo sapiens
ggtgcatccagccgggccact

SEQ ID NO: 471 - protein, 214 aa, Artificial Sequence
  Synthetic polypeptide
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIKRTVAAPSVFIFPPSDEQLKSGTAEVVCLLNNFYPREAKVQWKVDNALQSGNSQESVTEQDSKDSTYSLESTLTLSKADYEKHKVYACEVTHQGLSSPVTKSFNRGEC

SEQ ID NO: 472 - DNA, 21 bp, Homo sapiens
gctgcatccagtttgcaaagt

SEQ ID NO: 473 - protein, 214 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRTVAAPSVFIFPPSDEQLKSGTAKVVCLLNNFYPREAKVQWKVDNALQSGNSQESVTEQDSKDSTYSLKSTLTLSKADYEKHKVYACEVTHQGLSSPVTKSFNRGEC

SEQ ID NO: 474 - DNA, 24 bp, Homo sapiens
cagcagtatggtagctctcctacc

SEQ ID NO: 475 - protein, 214 aa, Artificial Sequence
  Synthetic polypeptide
DIQMTQSPSSLSASVGDRVTITCKASQNVGTNVAWYQQKPGKAPKALIYSASFLYSGVPSRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLESTLELSKADYEKHKVYACEVTHQGLSSPVTKSFNRGEC

SEQ ID NO: 476 - DNA, 27 bp, Homo sapiens
ctccagcataatagttaccctcccact

SEQ ID NO: 477 - protein, 448 aa, Artificial Sequence
  Synthetic polypeptide
EVQLVESGGGLVQPGGSLRLSCAASGYVFTDYGMNWVRQAPGKGLEWMGWINTYIGEPIYADAVKGRFTFSRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 478 - DNA, 15 bp, Homo sapiens
ggttactactggaac

SEQ ID NO: 479 - protein, 214 aa, Artificial Sequence
  Synthetic polypeptide
DIQMTQSPSSLSASVGDRVTITCKASQNVGTNVAWYQQKPGKAPKALIYSASFLYSGVPSRFSGSGSGTDFTLTISSLQPEDFATYYCQQYNIYPLTFGQGTKVEIKRTVAAPSVFIFPPSDEQLKSGTAEVVCLLNNFYPREAKVQWKVDNALQSGNSQESVTEQDSKDSTYSLESTLTLSKADYEKHKVYACEVTHQGLSSPVTKSFNRGEC

SEQ ID NO: 480 - DNA, 15 bp, Homo sapiens
agctatggcatgcac

SEQ ID NO: 481 - protein, 214 aa, Artificial Sequence
  Synthetic polypeptide
DIQMTQSPSSLSASVGDRVTITCKASQNVGTNVAWYQEKPGKAPKALIYSASFLYSGVPYRFSGSGSGTDFTLTISSLQPEDFATYYCQQYNIYPLTFGQGTKVEIKRTVAAPSVFIFPPSDEQLKSGTAEVVCLLNNFYPREAKVQWKVDNALQSGNSQESVTEQDSKDSTYSLESTLTLSKADYEKHKVYACEVTHQGLSSPVTKSFNRGEC

SEQ ID NO: 482 - DNA, 48 bp, Homo sapiens
gaaatcaatcatagtggaattaccaactacaacccgtccctcaagagt

SEQ ID NO: 483 - protein, 16 aa, Homo sapiens
EINHSGITNYNPSLKS

SEQ ID NO: 484 - DNA, 51 bp, Homo sapiens
gttatgtcatatgatggaaataataaattatatgcagactccgtgaagggc

SEQ ID NO: 485 - protein, 17 aa, Homo sapiens
VMSYDGNNKLYADSVKG

SEQ ID NO: 486 - DNA, 36 bp, Homo sapiens; identical to SEQ ID NO: 191

SEQ ID NO: 487 - protein, 448 aa, Artificial Sequence
  Synthetic polypeptide
EVQLVESGGGLVQPGGSLRLSCAASGYTFTDYGMNWVRKAPGKGLEWMGWINTYIGEPIYADSVKGRFTISRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 488 - DNA, 42 bp, Homo sapiens
gacgaaactgaaaccctctactactactacggtattgacgtc

SEQ ID NO: 489 - protein, 14 aa, Homo sapiens
DETETLYYYYGIDV

SEQ ID NO: 490 - DNA, 324 bp, Homo sapiens
gaaattgtgttgacgcagtctccaggcaccctgtctttgtctccaggggaaagagtcaccctctcctgcagggccagtcagagtgtaagaagcagctacttagcctggtaccagcagagagctggccaggctcccaggctcctcatctatggtgcatccagccgggccactggcatcccagacaggttcagtggcagtgggtctgggacagacttcactctcaccatcagcagactggagcctgaagattttgcagtgtattactgtcagcagtatggtagctctcctaccttcggccaagggacacgactggagattaaacga

SEQ ID NO: 491 - protein, 107 aa, Homo sapiens
EIVLTQSPGTLSLSPGERVTLSCRASQSVRSSYLAWYQQRAGQAPRLLIYGASSRATGIPDRFSGSGSGTDFTLTISRLEPEDFAVYYCQQYGSSPTFGQGTRLEIK

SEQ ID NO: 492 - DNA, 324 bp, Homo sapiens
gacatccagatgacccagtctccatcctccctgtctgcttctgtaggagacagagtcaccatcacttgccgggcaagtcagggcattagcaatgatttagcctggtatcagcagaaaccagggaaagcccctaagcgcctgatctttgctgcatccagtttgcaaagtggggtcccatcaaggttcagcggcagtggatctgggacagaattcactctcacaatcagcagcctgcagcctgaagattttgcaacttattactgtctccagcataatagttaccctcccactttcggcggagggaccaaggtggagatcaaacga

SEQ ID NO: 493 - protein, 107 aa, Homo sapiens
DIQMTQSPSSLSASVGDRVTITCRASQGISNDLAWYQQKPGKAPKRLIFAASSLQSGVPSRFSGSGSGTEFTLTISSLQPEDFATYYCLQHNSYPPTFGGGTKVEIK

SEQ ID NO: 494 - DNA, 360 bp, Homo sapiens
caggtgcagttacagcagtggggcgcaggactgttgaagccttcggagaccctgtccctcacctgcgatgtctatggtgggtccttcagtggttactactggaactggatccgccagcccccagggaaggggctggagtggattggggaaatcaatcatagtggaattaccaactacaacccgtccctcaagagtcgagtcaccatatcagtagacacgtccaagaaccagttctccctgaagctgagctctgtgaccgccgcggacacggctgtgtattactgtgcgagaggatattgtagaagtaccacctgctactttgactactggggccagggaaccctggtcaccgtctcctca

SEQ ID NO: 495 - protein, 120 aa, Homo sapiens
QVQLQQWGAGLLKPSETLSLTCDVYGGSFSGYYWNWIRQPPGKGLEWIGEINHSGITNYNPSLKSRVTISVDTSKNQFSLKLSSVTAADTAVYYCARGYCRSTTCYFDYWGQGTLVTVSS

SEQ ID NO: 496 - DNA, 369 bp, Homo sapiens
caggtgcagctggtggagtctgggggaggcgtggtccagcctgggaggtccctgagactctcctgtgcagcctctggattcaccctcagtagctatggcatgcactgggtccgccaggctccaggcaaggggctggagtgggtggcagttatgtcatatgatggaaataataaattatatgcagactccgtgaagggccgattcaccatctccagagacaattccaagaaaacgctgtatctgcaaatgaacagcctgagagctgaggacacggctgtgtattactgtgcgagagacgaaactgaaaccctctactactactacggtattgacgtctggggccaagggaccacggtcaccgtctcctca

SEQ ID NO: 497 - protein, 123 aa, Homo sapiens
QVQLVESGGGVVQPGRSLRLSCAASGFTLSSYGMHWVRQAPGKGLEWVAVMSYDGNNKLYADSVKGRFTISRDNSKKTLYLQMNSLRAEDTAVYYCARDETETLYYYYGIDVWGQGTTVTVSS

SEQ ID NO: 498 - DNA, 57 bp, Homo sapiens
atgaaacatctgtggttcttcctgctgctggtggcggcgccgcgctgggtgctgagc

SEQ ID NO: 499 - protein, 19 aa, Homo sapiens
MKHLWFFLLLVAAPRWVLS

SEQ ID NO: 500 - DNA, 60 bp, Homo sapiens
atggaaaccccagcgcagcttctcttcctcctgctactctggctcccagataccaccgga

SEQ ID NO: 501 - protein, 20 aa, Homo sapiens
METPAQLLFLLLLWLPDTTG

SEQ ID NO: 502 - DNA, 66 bp, Homo sapiens
atggacatgagggtgcccgctcagctcctggggctcctgctgctgtggctgagaggtgccagatgt

SEQ ID NO: 503 - protein, 22 aa, Homo sapiens
MDMRVPAQLLGLLLLWLRGARC

SEQ ID NO: 504 - protein, 20 aa, Homo sapiens
MEAPAQLLFLLLLWLPDTTG

SEQ ID NO: 505 - protein, 19 aa, Homo sapiens
MEWTWRVLFLVAAATGAHS

SEQ ID NO: 506 - protein, 19 aa, Homo sapiens
MEWSWVFLFFLSVTTGVHS

SEQ ID NO: 507 - DNA, 1407 bp, Artificial Sequence
  Synthetic polynucleotide
atgaaacatctgtggttcttcctgctgctggtggcggcgccgcgctgggtgctgagccaggtgcagttacagcagtcgggcgcaggactgttgaagccttcggagaccctgtccctcacctgcgctgtccatggtgggtccttcagtggttactactggaactggatccgcgagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 508 - protein, 450 aa, Artificial Sequence
  Synthetic polypeptide
QVQLQQSGAGLLKPSETLSLTCAVHGGSFSGYYWNWIREPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 509 - DNA, 708 bp, Artificial Sequence
  Synthetic polynucleotide
atggacatgagggtgcccgctcagctcctggggctcctgctgctgtggctgagaggtgccagatgtgacattcaaatgacccagagcccatccagcctgagcgcatctgtaggagaccgggtcaccatcacttgtaaagccagtcagaacgtaggtactaacgtagcctggtatcaggaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 510 - protein, 236 aa, Artificial Sequence
  Synthetic polypeptide
MDMRVPAQLLGLLLLWLRGARCDIQMTQSPSSLSASVGDRVTITCKASQNVGTNVAWYQEKPGKAPKALIYSASFLYSGVPYRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 511 - DNA, 702 bp, Artificial Sequence
  Synthetic polynucleotide
atggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagaagcagttacttagcctggtaccagaagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 512 - protein, 214 aa, Artificial Sequence
  Synthetic polypeptide
EIVLTQSPGTLSLSPGERATLSCRASQSVRSSYLAWYQKKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 513 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagaaaggccccgggaaagggcctggaatggatgggttggattaatacttacattggagagcctatttatgctgacagcgtcaagggcagattcacgttctctctagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 514 - protein, 470 aa, Artificial Sequence
  Synthetic polypeptide
MDMRVPAQLLGLLLLWLRGARCEVQLVESGGGLVQPGGSLRLSCAASGYVFTDYGMNWVRKAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 515 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacaccttcacagactatggaatgaattgggttagaaaggccccgggaaagggcctggaatggatgggttggattaatacttacattggagagcctatttatgctgacagcgtcaagggcagattcacgatctctcgagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 516 - protein, 470 aa, Artificial Sequence
  Synthetic polypeptide
MDMRVPAQLLGLLLLWLRGARCEVQLVESGGGLVQPGGSLRLSCAASGYTFTDYGMNWVRKAPGKGLEWMGWINTYIGEPIYADSVKGRFTISRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 517 - DNA, 708 bp, Artificial Sequence
  Synthetic polynucleotide
atggacatgagggtgcccgctcagctcctggggctcctgctgctgtggctgagaggtgcgcgctgtgacatccagatgacccagtctccatcctccctgtctgcatctgtaggagacagagtcaccatcacttgccgggcaagtcaggacatcagaaatgatttaggctggtatcaggagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 518 - protein, 236 aa, Artificial Sequence
  Synthetic polypeptide
MDMRVPAQLLGLLLLWLRGARCDIQMTQSPSSLSASVGDRVTITCRASQDIRNDLGWYQEKPGKAPKRLIYAASSLQSGVPSRFSGSGSGPEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 519 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacaccttcacagactatggaatgaattgggttagacaggccccgggaaagggcctggaatggatgggttggattaatacttacattggagagcctatttatgctgacagcgtcaagggcagattcacgatctctcgagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 520 - protein, 214 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLKSTLKLSKADYEKHKVYACEVTHQGLSSPVTKSFNRGEC

SEQ ID NO: 521 - DNA, 1428 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgcaaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 522 - protein, 476 aa, Artificial Sequence
  Synthetic polypeptide
MDMRVPAQLLGLLLLWLRGARCQVQLVESGGGVVQPGRSLRLSCAASGFTFSSYDMHWVRKAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 523 - protein, 234 aa, Homo sapiens
METPAQLLFLLLLWLPDTTGEIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 524 - DNA, 642 bp, Homo sapiens
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 525 - DNA, 726 bp, Homo sapiens
atggacatgagggtgccggcccagctcctcggtcttctgttgctctggctccgtggtgcccgctgtgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 526 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctggagctgagcaaagcagactacgagaaacacaaagtctacgcctgcgaagtcacccatcagggcctgagctcaccagtaacaaaaagctttaatagaggagagtgt

SEQ ID NO: 527 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgaagctgagcaaagcagactacgagaaacacaaagtctacgcctgcgaagtcacccatcagggcctgagctcgcccgtcacaaagagcttcaacaggggagagtgt

SEQ ID NO: 528 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatggcttggattaatacttacattggagagcctatttatgctgacagcgtcaagggcagattcacgatctctcgagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 529 - DNA, 1350 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctctagtgcctccaccaagggcccatcggtcttccccctggcaccctcctccaagagcacctctgggggcacagcggccctgggctgcctggtcgaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 530 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggaactgccaaagttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 531 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgccgaagttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 532 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatgggttggattaatacttacattggagagcctatttatgctgacgccgtcaagggcagattcacgttctctcgagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 533 - DNA, 642 bp, Artificial Sequence
  Artificial polynucleotide
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatccaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgccgaagttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 534 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatccaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctggagctgagcaaagcagactacgagaaacacaaagtctacgcctgcgaagtcacccatcagggcctgagctcaccagtaacaaaaagctttaatagaggagagtgt

SEQ ID NO: 535 - protein, 450 aa, Artificial Sequence
  Synthetic polypeptide
QVQLQQSGAGLLKPSETLSLTCAVHGGSFSGYYWNWIREPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVEDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 536 - protein, 214 aa, Artificial Sequence
  Synthetic polypeptide
DIQMTQSPSSLSASVGDRVTITCKASQNVGTNVAWYQEKPGKAPKALIYSASFLYSGVPSRFSGSGSGTDFTLTISSLQPEDFATYYCQQYNIYPLTFGQGTKVEIKRTVAAPSVFIFPPSDEQLKSGTAEVVCLLNNFYPREAKVQWKVDNALQSGNSQESVTEQDSKDSTYSLESTLTLSKADYEKHKVYACEVTHQGLSSPVTKSFNRGEC

SEQ ID NO: 537 - protein, 214 aa, Artificial Sequence
  Synthetic polypeptide
DIQMTQSPSSLSASVGDRVTITCRASQDIRNDLGWYQEKPGKAPKLLIYAASSLQSGVPSRFSGSGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 538 - protein, 214 aa, Artificial Sequence
  Synthetic polypeptide
DIQMTQSPSSLSASVGDRVTITCRASQDIRNDLGWYQEKPGKAPKLLIYAASSLQSGVPSRFSGSGSGPEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 539 - protein, 220 aa, Artificial Sequence
  Synthetic polypeptide
DIQMTQSPSSLSASVGDRVTITCRSSQSVLYSSNNKNYLVWYQKKPGKVPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 540 - protein, 214 aa, Artificial Sequence
  Synthetic polypeptide
DIQMTQSPSSLSASVGDRVTITCKASQNVGTNVAWYQEKPGKAPKALIYSASFLYSGVPSRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 541 - protein, 214 aa, Artificial Sequence
  Synthetic polypeptide
DIQMTQSPSSLSASVGDRVTITCRASQSINNYLNWYQKKPGKAPKLLIYATSSLQSGVPSRFSGSGSGTDFSLTISSLQPEDFATYFCQQSYSTPRTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 542 - protein, 217 aa, Artificial Sequence
  Synthetic polypeptide
QSVLTQPPSVSGAPGQRVTISCTGSSSNIGAGYDVHWYQEFPGTAPKLLIQGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 543 - protein, 214 aa, Artificial Sequence
  Synthetic polypeptide
DIQMTQSPSSLSASVGDRVTITCRTSQDIRDDLGWYQKKPGKAPKLLIYDASSLQSGVPSRFSGSGSGTEFTLTISSLQPEDFATYYCLQHNSYPPTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 544 - protein, 214 aa, Artificial Sequence
  Synthetic polypeptide
DIQMTQSPSSLSASVGDRVTITCRTSQDIRDDLGWYQKKPGKAPKRLIYDASSLQSGVPSRFSGSGSGTEFTLTISSLQPEDFATYYCLQHNSYPPTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 545 - protein, 214 aa, Artificial Sequence
  Synthetic polypeptide
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGEGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 546 - protein, 214 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGKGTRLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 547 - protein, 214 aa, Artificial Sequence
  Synthetic polypeptide
DIQMTQSPSSLSASVGDRVTITCRASQDIRNDLGWYQQKPGKAPKRLIYAASSLQSGVPSRFSGSGSGPEFTLTISSLQPEDFATYYCLQHNSYPLTFGEGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 548 - protein, 214 aa, Artificial Sequence
  Synthetic polypeptide
DIQMTQSPSSLSASVGDRVTITCRASQSINNYLNWYQQKPGKAPKLLIYATSSLQSGVPSRFSGSGSGTDFSLTISSLQPEDFATYFCQQSYSTPRTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 549 - protein, 220 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 550 - protein, 220 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDFATYYCQQYYKTPLTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 551 - protein, 214 aa, Artificial Sequence
  Synthetic polypeptide
DIQMTQSPSSLSASVGDRVTITCRTSQDIRDDLGWYQQKPGKAPKLLIYDASSLQSGVPSRFSGSGSGTEFTLTISSLQPEDFATYYCLQHNSYPPTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 552 - protein, 214 aa, Artificial Sequence
  Synthetic polypeptide
DIQMTQSPSSLSASVGDRVTITCRTSQDIRDDLGWYQQKPGKAPKRLIYDASSLQSGVPSRFSGSGSGTEFTLTISSLQPEDFATYYCLQHNSYPPTFGKGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 553 - DNA, 1404 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 554 - DNA, 1350 bp, Artificial Sequence
  Synthetic polynucleotide
caggtgcagttacagcagtggggcgcaggactgttgaagccttcggagaccctgtccctcacctgcgctgtccatggtgggtccttcagtggttactactggaactggatccgcgagccaccagggaaggggctagagtggattggggaaatcaatcatgctggaatcaccaactacaacccgtccctcaagagtcgagtcaccatatcattagacacgtccaagaaccagttctccctgaagctgacctctgtgaccgccgcggacacggctgtgtattactgtgcgagaggatattgtagaagtaccacctgctactttgactactggggccagggaaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 555 - protein, 450 aa, Artificial Sequence
  Synthetic polypeptide
QVQLQQWGAGLLKPSETLSLTCAVHGGSFSGYYWNWIREPPGKGLEWIGEINHAGITNYNPSLKSRVTISLDTSKNQFSLKLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 556 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctatctgcatctgtaggagacagagtcaccatcacttgccgggcaagtcagagcattaacaactatttaaattggtatcagaagaaaccagggaaagcccctaagctcctgatctatgctacatccagtttgcaaagtggggtcccatcaaggttcagtggcagtggatctgggacagatttctctctcaccatcagcagtctgcaacctgaagattttgcaacttacttctgtcaacagagttacagtacccctcggacgttcggccaagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 557 - DNA, 1344 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccgggagcccccagggaagggactggagtggattgggtatatctattacagtgggagcaccaactacaacccctccctcaagagtcgagtcaccatgtcaatagacacgtccaagaaccagttctccctgaagctgagctctgtgaccgctgcggacacggccgtgtattactgtgcgagagaaattgggagctactacggctttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 558 - protein, 448 aa, Artificial Sequence
  Synthetic polypeptide
QVQLQESGPGLVKPSETLSLTCTVSGGSISSYFWSWIREPPGKGLEWIGYIYYSGSTNYNPSLKSRVTMSIDTSKNQFSLKLSSVTAADTAVYYCAREIGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 559 - DNA, 726 bp, Artificial Sequence
  Synthetic polynucleotide
atggacatgagggtgccggcccagctcctcggtcttctgttgctctggctccgtggtgcccgctgtgacatccagatgacccagtctccaagctccctgtctgcgtctgtgggcgatagggtcaccatcacttgcaggtccagccagagtgtgttatacagctccaacaataagaactacttagtttggtaccagaagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 560 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcaggaaaaaccaggtaaagccccaaaagccctcatctacagtgcctctttcctctatagtggtgtaccatccaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 561 - DNA, 1422 bp, Artificial Sequence
  Synthetic polynucleotide
atgaaacatctgtggttcttcctgctgttggtggcagcccccagatgggtgctgagccaggtacagttgcaggagtcaggtccaggactggtgaagccctcggagaccctctcactcacctgtaccatctccggggacagtgtctctaccaacagtgttgcttggaactggatcagggagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 562 - protein, 455 aa, Artificial Sequence
  Synthetic polypeptide
QVQLQESGPGLVKPSETLSLTCTISGDSVSTNSVAWNWIREPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 563 - DNA, 726 bp, Artificial Sequence
  Synthetic polynucleotide
atggacatgagggtgccggcccagctcctcggtcttctgttgctctggctccgtggtgcccgctgtgacatccagatgacccagtctccaagctccctgtctgcgtctgtgggcgatagggtcaccatcacttgcaggtccagccagagtgtgttatacagctccaacaataagaactacttagtttggtaccagaagaaaccaggaaaggttcctaaactgctcatttactgggcatctacccgggaatccggggtccctagtcgattcagtggcagcgggtctgggacagatttcactctcaccatcagcagcctgcagcctgaagatttcgcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 564 - DNA, 1431 bp, Artificial Sequence
  Synthetic polynucleotide
atggacatgagagtgcctgcacagctgctgggcctgctgctgctgtggctgagaggcgccagatgcgaggtacagttgctggagtcaggtggaggactggtgcagcccggggggagcctccgactcagctgtgccatctccggggacagtgtctctaccaacagtgttgcttggaactggatcagggaggccccagggaaaggccttgagtgggtgagcaggacatactacaggtccaagtggtataatgattatgcagtttctgtgaaaggtcgattcactatcagcccagacacatccaagaacacgttctacctgcagatgaactctctgagagccgaggacacggctgtgtattactgtgcaagagaggatggggatagctactaccgctacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 565 - protein, 455 aa, Artificial Sequence
  Synthetic polypeptide
EVQLLESGGGLVQPGGSLRLSCAISGDSVSTNSVAWNWIREAPGKGLEWVSRTYYRSKWYNDYAVSVKGRFTISPDTSKNTFYLQMNSLRAEDTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 566 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctgtctgcatctgtaggagacagagtcaccatcacttgccggacaagtcaggacattagagatgatttaggctggtatcagaagaaaccagggaaagcccctaagctcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 567 - DNA, 1425 bp, Artificial Sequence
  Synthetic polynucleotide
atggacatgagagtgcctgcacagctgctgggcctgctgctgctgtggctgagaggcgccagatgccaggtgcagctggtggagtctgggggaggcgtggtccagcctgggaggtccctgagactctcctgtgcagcctctggattcaccttcagtagctatggcatgcactgggtccgcgaggctccaggcaaggggctggagtgggtggcagtcatatcatatgatggaaataataaactctatacagactccgtgaagggccgattcaccatctccagagacgattccaagagcacgctgtatctgcaaatgaacagcctgagagctgaggacacggctgtgtattactgtgcgagagatccaacagtaactctctactactactacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 568 - protein, 453 aa, Artificial Sequence
  Synthetic polypeptide
QVQLVESGGGVVQPGRSLRLSCAASGFTFSSYGMHWVREAPGKGLEWVAVISYDGNNKLYTDSVKGRFTISRDDSKSTLYLQMNSLRAEDTAVYYCARDPTVTLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 569 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctgtctgcatctgtaggagacagagtcaccatcacttgccggacaagtcaggacattagagatgatttaggctggtatcagaagaaaccagggaaagcccctaagcgcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggccaagggaccaaggtggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 570 - DNA, 717 bp, Artificial Sequence
  Synthetic polynucleotide
atggacatgagggtgcccgctcagctcctggggctcctgctgctgtggctgagaggtgcgcgctgtcagtctgtgctgacgcagccgccctcagtgtctggggccccagggcagagggtcaccatctcctgcactgggagcagttccaacatcggggcaggttatgatgtacactggtaccaggagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccgagagctatctgagcctgacgcctgagcagtggaagtcccacagaagctacagctgccaggtcacgcatgaagggagcaccgtggagaagacagtggcccctacagaatgttca

SEQ ID NO: 571 - protein, 446 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 572 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagaaaggccccgggaaagggcctggaatggatgggttggattaatacttacattggagagcctatttatgctgacagcgtcaagggcagattcacgatctctctagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 573 - protein, 448 aa, Artificial Sequence
  Synthetic polypeptide
EVQLVESGGGLVQPGGSLRLSCAASGYVFTDYGMNWVRKAPGKGLEWMGWINTYIGEPIYADSVKGRFTISLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 574 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggcaaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 575 - DNA, 1350 bp, Artificial Sequence
  Synthetic polynucleotide
caggtgcagttacagcagtggggcgcaggactgttgaagccttcggagaccctgtccctcacctgcgctgtccatggtgggtccttcagtggttactactggaactggatccgccagccaccagggaaggagctagagtggattggggaaatcaatcatgctggaatcaccaactacaacccgtccctcaagagtcgagtcaccatatcattagacacgtccaagaaccagttctccctgaagctgacctctgtgaccgccgcggacacggctgtgtattactgtgcgagaggatattgtagaagtaccacctgctactttgactactggggccagggaaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 576 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcagcaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtgagggtactaaagtagaaatcaaacgtacggtagcggccccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 577 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagaagctggaatggatgggttggattaatacttacattggagagcctatttatgctgacagcgtcaagggcagattcacgttctctctagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 578 - protein, 448 aa, Artificial Sequence
  Synthetic polypeptide
EVQLVESGGGLVQPGGSLRLSCAASGYVFTDYGMNWVRQAPGKKLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 579 - protein, 450 aa, Artificial Sequence
  Synthetic polypeptide
QVQLQQWGAGLLKPSETLSLTCAVHGGSFSGYYWNWIRQPPGKELEWIGEINHAGITNYNPSLKSRVTISLDTSKNQFSLKLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 580 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctatctgcatctgtaggagacagagtcaccatcacttgccgggcaagtcagagcattaacaactatttaaattggtatcagcagaaaccagggaaagcccctaagctcctgatctatgctacatccagtttgcaaagtggggtcccatcaaggttcagtggcagtggatctgggacagatttctctctcaccatcagcagtctgcaacctgaagattttgcaacttacttctgtcaacagagttacagtacccctcggacgttcggcaaagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 581 - DNA, 1344 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccagggaaggaactggagtggattgggtatatctattacagtgggagcaccaactacaacccctccctcaagagtcgagtcaccatgtcaatagacacgtccaagaaccagttctccctgaagctgagctctgtgaccgctgcggacacggccgtgtattactgtgcgagagaaattgggagctactacggctttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 582 - protein, 448 aa, Artificial Sequence
  Synthetic polypeptide
QVQLQESGPGLVKPSETLSLTCTVSGGSISSYFWSWIRQPPGKELEWIGYIYYSGSTNYNPSLKSRVTMSIDTSKNQFSLKLSSVTAADTAVYYCAREIGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 583 - DNA, 726 bp, Artificial Sequence
  Synthetic polynucleotide
atggacatgagggtgccggcccagctcctcggtcttctgttgctctggctccgtggtgcccgctgtgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcaaagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 584 - DNA, 1422 bp, Artificial Sequence
  Synthetic polynucleotide
atgaaacatctgtggttcttcctgctgttggtggcagcccccagatgggtgctgagccaggtacagttgcaggagtcaggtccaggactggtgaagccctcggagaccctctcactcacctgtaccatctccggggacagtgtctctaccaacagtgttgcttggaactggatcaggcagcccccagggaaagagcttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 585 - protein, 455 aa, Artificial Sequence
  Synthetic polypeptide
QVQLQESGPGLVKPSETLSLTCTISGDSVSTNSVAWNWIRQPPGKELEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 586 - DNA, 1431 bp, Artificial Sequence
  Synthetic polynucleotide
atggacatgagagtgcctgcacagctgctgggcctgctgctgctgtggctgagaggcgccagatgcgaggtacagttgctggagtcaggtggaggactggtgcagcccggggggagcctccgactcagctgtgccatctccggggacagtgtctctaccaacagtgttgcttggaactggatcaggcaggccccagggaaagagcttgagtgggtgagcaggacatactacaggtccaagtggtataatgattatgcagtttctgtgaaaggtcgattcactatcagcccagacacatccaagaacacgttctacctgcagatgaactctctgagagccgaggacacggctgtgtattactgtgcaagagaggatggggatagctactaccgctacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 587 - DNA, 726 bp, Artificial Sequence
  Synthetic polynucleotide
atggacatgagggtgccggcccagctcctcggtcttctgttgctctggctccgtggtgcccgctgtgacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatttcgcaacttattactgtcagcaatattataagactcctctcactttcggcaaagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 588 - protein, 455 aa, Artificial Sequence
  Synthetic polypeptide
EVQLLESGGGLVQPGGSLRLSCAISGDSVSTNSVAWNWIRQAPGKELEWVSRTYYRSKWYNDYAVSVKGRFTISPDTSKNTFYLQMNSLRAEDTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 589 - DNA, 1425 bp, Artificial Sequence
  Synthetic polynucleotide
atggacatgagagtgcctgcacagctgctgggcctgctgctgctgtggctgagaggcgccagatgccaggtgcagctggtggagtctgggggaggcgtggtccagcctgggaggtccctgagactctcctgtgcagcctctggattcaccttcagtagctatggcatgcactgggtccgccaggctccaggcaaggagctggagtgggtggcagtcatatcatatgatggaaataataaactctatacagactccgtgaagggccgattcaccatctccagagacgattccaagagcacgctgtatctgcaaatgaacagcctgagagctgaggacacggctgtgtattactgtgcgagagatccaacagtaactctctactactactacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 590 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctgtctgcatctgtaggagacagagtcaccatcacttgccggacaagtcaggacattagagatgatttaggctggtatcagcagaaaccagggaaagcccctaagctcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggcaaagggaccaaggtggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 591 - protein, 453 aa, Artificial Sequence
  Synthetic polypeptide
QVQLVESGGGVVQPGRSLRLSCAASGFTFSSYGMHWVRQAPGKELEWVAVISYDGNNKLYTDSVKGRFTISRDDSKSTLYLQMNSLRAEDTAVYYCARDPTVTLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 592 - DNA, 708 bp, Artificial Sequence
  Synthetic polynucleotide
atggacatgagagtgcctgcacagctgctgggcctgctgctgctgtggctgagaggcgccagatgcgacatccagatgacccagtctccatcctccctgtctgcatctgtaggagacagagtcaccatcacttgccggacaagtcaggacattagagatgatttaggctggtatcagcagaaaccagggaaagcccctaagcgcctgatctatgatgcatccagtttgcaaagtggggtcccatcaaggttcagcggcagtggatctgggacagaattcactctcacaatcagcagcctgcagcctgaagattttgcaacttattactgtctacagcataatagttaccctccgacgttcggcaaagggaccaaggtggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 593 - DNA, 708 bp, Artificial Sequence
  Synthetic polynucleotide
atggacatgagggtgcccgctcagctcctggggctcctgctgctgtggctgagaggtgcgcgctgtgacatccagatgacccagtctccatcctccctgtctgcatctgtaggagacagagtcaccatcacttgccgggcaagtcaggacatcagaaatgatttaggctggtatcagcagaaaccagggaaagcccctaagcgcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcgaagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 594 - DNA, 1428 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaagaagctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 595 - protein, 454 aa, Artificial Sequence
  Synthetic polypeptide
QVQLVESGGGVVQPGRSLRLSCAASGFTFSSYDMHWVRQAPGKKLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 596 - DNA, 1350 bp, Artificial Sequence
  Synthetic polynucleotide
caggtgcagttacagcagtggggcgcaggactgttgaagccttcggagaccctgtccctcacctgcgctgtccatggtgggtccttcagtggttactactggaactggatccgccagccaccagggaaggggctagagtggattggggaaatcaatcatgctggaatcaccaactacaacccgtccctcaagagtcgagtcaccatatcattagacacgtccaagaaccagttctccctgaagctgacctctgtgaccgccgcggacacggctgtgtattactgtgcgagaggatattgtagaagtaccacctgctactttgactactggggccagggaaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 597 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatgggttggattaatacttacattggagagcctatttatgctgacagcgtcaagggcagattcacgttctctctagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 598 - protein, 450 aa, Artificial Sequence
  Synthetic polypeptide
QVQLQQWGAGLLKPSETLSLTCAVHGGSFSGYYWNWIRQPPGKGLEWIGEINHAGITNYNPSLKSRVTISLDTSKNQFSLKLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 599 - protein, 448 aa, Artificial Sequence
  Synthetic polypeptide
EVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 600 - DNA, 1344 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccagggaagggactggagtggattgggtatatctattacagtgggagcaccaactacaacccctccctcaagagtcgagtcaccatgtcaatagacacgtccaagaaccagttctccctgaagctgagctctgtgaccgctgcggacacggccgtgtattactgtgcgagagaaattgggagctactacggctttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 601 - protein, 448 aa, Artificial Sequence
  Synthetic polypeptide
QVQLQESGPGLVKPSETLSLTCTVSGGSISSYFWSWIRQPPGKGLEWIGYIYYSGSTNYNPSLKSRVTMSIDTSKNQFSLKLSSVTAADTAVYYCAREIGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 602 - DNA, 1422 bp, Artificial Sequence
  Synthetic polynucleotide
atgaaacatctgtggttcttcctgctgttggtggcagcccccagatgggtgctgagccaggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 603 - protein, 455 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 604 - DNA, 1431 bp, Artificial Sequence
  Synthetic polynucleotide
atggacatgagagtgcctgcacagctgctgggcctgctgctgctgtggctgagaggcgccagatgcgaggtacagttgctggagtcaggtggaggactggtgcagcccggggggagcctccgactcagctgtgccatctccggggacagtgtctctaccaacagtgttgcttggaactggatcaggcaggccccagggaaaggccttgagtgggtgagcaggacatactacaggtccaagtggtataatgattatgcagtttctgtgaaaggtcgattcactatcagcccagacacatccaagaacacgttctacctgcagatgaactctctgagagccgaggacacggctgtgtattactgtgcaagagaggatggggatagctactaccgctacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 605 - protein, 455 aa, Artificial Sequence
  Synthetic polypeptide
EVQLLESGGGLVQPGGSLRLSCAISGDSVSTNSVAWNWIRQAPGKGLEWVSRTYYRSKWYNDYAVSVKGRFTISPDTSKNTFYLQMNSLRAEDTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 606 - DNA, 1425 bp, Artificial Sequence
  Synthetic polynucleotide
atggacatgagagtgcctgcacagctgctgggcctgctgctgctgtggctgagaggcgccagatgccaggtgcagctggtggagtctgggggaggcgtggtccagcctgggaggtccctgagactctcctgtgcagcctctggattcaccttcagtagctatggcatgcactgggtccgccaggctccaggcaaggggctggagtgggtggcagtcatatcatatgatggaaataataaactctatacagactccgtgaagggccgattcaccatctccagagacgattccaagagcacgctgtatctgcaaatgaacagcctgagagctgaggacacggctgtgtattactgtgcgagagatccaacagtaactctctactactactacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaagaagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 607 - protein, 453 aa, Artificial Sequence
  Synthetic polypeptide
QVQLVESGGGVVQPGRSLRLSCAASGFTFSSYGMHWVRQAPGKGLEWVAVISYDGNNKLYTDSVKGRFTISRDDSKSTLYLQMNSLRAEDTAVYYCARDPTVTLYYYYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKKMTKNQVSLTCLVKGFYPSDIAVEWESNGQPENNYKTTPPVLKSDGSFFLYSKLTVDKSRWQQGNVFSCSVMHEALHNHYTQKSLSLSPGK

SEQ ID NO: 608 - DNA, 1404 bp, Artificial Sequence
  Synthetic polynucleotide
atggacatgagggtgcccgctcagctcctggggctcctgctgctgtggctgagaggtgcgcgctgtgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 609 - protein, 446 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 610 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagacaggccccgggaaagggcctggaatggatgggttggattaatacttacattggagagcctatttatgctgacagcgtcaagggcagattcacgatctctctagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 611 - protein, 448 aa, Artificial Sequence
  Synthetic polypeptide
EVQLVESGGGLVQPGGSLRLSCAASGYVFTDYGMNWVRQAPGKGLEWMGWINTYIGEPIYADSVKGRFTISLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 612 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacaccttcacagactatggaatgaattgggttagacaggccccgggaaagggcctggaatggatgggttggattaatacttacattggagagcctatttatgctgacagcgtcaagggcagattcacgatctctcgagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 613 - protein, 448 aa, Artificial Sequence
  Synthetic polypeptide
EVQLVESGGGLVQPGGSLRLSCAASGYTFTDYGMNWVRQAPGKGLEWMGWINTYIGEPIYADSVKGRFTISRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 614 - DNA, 1428 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcgatggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 615 - protein, 454 aa, Artificial Sequence
  Synthetic polypeptide
QVQLVESGGGVVQPGRSLRLSCAASGFTFSSYDMHWVRQAPGKGLEWVAVISYDGSIKYYADSVKGRFTISRDNSKNTLYLQVNSLRAEDTAVYYCAREVRSGSYYYYYSMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVDGFYPSDIAVEWESNGQPENNYDTTPPVLDSDGSFFLYSDLTVDKSRWQQGNVFSCSVMHEALHNHYTQKSLSLSPGK

SEQ ID NO: 616 - protein, 448 aa, Artificial Sequence
  Synthetic polypeptide
EVQLVESGGGLVQPGGSLRLSCAASGYVFTDYGMNWVRKAPGKGLEWMGWINTYIGEPIYADAVKGRFTFSRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 617 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagaaaggccccgggaaagggcctggaatggatgggttggattaatacttacattggagagcctatttatgctgacgccgtcaagggcagattcacgttctctcgagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 618 - DNA, 1350 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgcgagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 619 - DNA, 1410 bp, Artificial Sequence
  Synthetic polynucleotide
atggacatgagagtgcctgcacagctgctgggcctgctgctgctgtggctgagaggcgccagatgcgaggttcagctggtcgagtcaggaggcggtctcgtgcagcctggcggatcactgagattgtcctgtgctgcatctggttacgtcttcacagactatggaatgaattgggttagaaaggccccgggaaagggcctggaatggatggcttggattaatacttacattggagagcctatttatgctgacagcgtcaagggcagattcacgatctctcgagacacatccaagtcaacagcatacctccaaatgaatagcctgagagcagaggacaccgcagtgtactattgtgctagaggatacagatcttatgccatggactactggggccagggtaccctagtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 620 - protein, 448 aa, Artificial Sequence
  Synthetic polypeptide
EVQLVESGGGLVQPGGSLRLSCAASGYVFTDYGMNWVRKAPGKGLEWMAWINTYIGEPIYADSVKGRFTISRDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 621 - DNA, 1428 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgcaaggctccaggcaaggggctggagtgggtggcagttatatcatatgatggaagtattaaatactatgcagactccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 622 - DNA, 708 bp, Artificial Sequence
  Synthetic polynucleotide
atggacatgagggtgcccgctcagctcctggggctcctgctgctgtggctgagaggtgcgcgctgtgacatccagatgacccagtctccatcctccctgtctgcatctgtaggagacagagtcaccatcacttgccgggcaagtcaggacatcagaaatgatttaggctggtatcaggagaaaccagggaaagcccctaagctcctgatctatgctgcgtccagtttgcaaagtggggtcccatcaaggttcagcggcagtggatctgggccagaattcactctcacaatcagcagcctgcagcctgaagattttgcaacttattactgtctacaacataatagttatccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 623 - protein, 454 aa, Artificial Sequence
  Synthetic polypeptide
QVQLVESGGGVVQPGRSLRLSCAASGFTFSSYDMHWVRKAPGKGLEWVAVISYDGSIKYYADSVKGRFTISRDNSKNTLYLQVNSLRAEDTAVYYCAREVRSGSYYYYYSMDVWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 624 - DNA, 1428 bp, Artificial Sequence
  Synthetic polynucleotide
atggacatgagggtgcccgctcagctcctggggctcctgctgctgtggctgagaggtgcgcgctgtcaggtgcagttggtggagtctgggggaggcgtggtccagcctgggaggtccctgagactctcctgtgcagcctctggattcaccttcagtagctatgacatgcactgggtccgcaaggctccaggcaaggggctggagtgggtggcagttatatcatatgatgcaagtattaaatactatgcagaatccgtgaagggccgattcaccatctccagagacaattccaagaacacgctgtatctgcaagtgaacagcctgagagctgaggacacggctgtgtattactgtgcgagagaggtccgtagtgggagctactactattactacagtatggacgtctggggccaagggaccttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcagaagagcctctccctgtctccgggtaaa

SEQ ID NO: 625 - DNA, 708 bp, Artificial Sequence
  Synthetic polynucleotide
atggacatgagggtgcccgctcagctcctggggctcctgctgctgtggctgagaggtgcgcgctgtgacatccagatgacccagtctccatcctccctgtctgcatctgtaggagacagagtcaccatcacttgccgggcaagtcaggacatcagaaatgatttaggctggtatcaggagaaaccagggaaagcccctaagctcctgatctatgctgcgtccagtttgcaaagtggggtcccatcaaggttcagcggcagtggatctgggacagaattcactctcacaatcagcagcctgcagcctgaagattttgcaacttattactgtctacaacataatagttatccgctcactttcggcggagggaccaaggtggagatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 626 - protein, 454 aa, Artificial Sequence
  Synthetic polypeptide
QVQLVESGGGVVQPGRSLRLSCAASGFTFSSYDMHWVRKAPGKGLEWVAVISYDASIKYYAESVKGRFTISRDNSKNTLYLQVNSLRAEDTAVYYCAREVRSGSYYYYYSMDVWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQKSLSLSPGK

SEQ ID NO: 627 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagaagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgccaaagttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 628 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcaggaaaaaccaggtaaagccccaaaagccctcatctacagtgcctctttcctctatagtggtgtaccatacaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgccgaagttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 629 - DNA, 1350 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgcgagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctctagtgcctccaccaagggcccatcggtcttccccctggcaccctcctccaagagcacctctgggggcacagcggccctgggctgcctggtcgaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 630 - DNA, 642 bp, Artificial Sequence
  Synthetic polynucleotide
gacattcaaatgacccagagcccatccagcctgagcgcatctgtaggagaccgggtcaccatcacttgtaaagccagtcagaacgtaggtactaacgtagcctggtatcaggaaaaaccaggtaaagccccaaaagccctcatctacagtgcctctttcctctatagtggtgtaccatccaggttcagcggatccggtagtggtactgatttcaccctcacgatcagtagcctccagccagaagatttcgccacttattactgtcaacagtataacatctacccactcacattcggtcagggtactaaagtagaaatcaaacgtacggtagcggccccatctgtcttcatcttcccgccatctgatgagcagttgaaatctggaactgccgaagttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcaccagtaacaaaaagctttaatagaggagagtgt

SEQ ID NO: 631 - protein, 9 aa, Artificial Sequence
  Synthetic polypeptide
LQHQSYPPT

SEQ ID NO: 632 - protein, 7 aa, Artificial Sequence
  Synthetic polypeptide
TQSVAWN

SEQ ID NO: 633 - protein, 16 aa, Artificial Sequence
  Synthetic polypeptide
YIYYSGQTKYNPSLKS

SEQ ID NO: 634 - protein, 16 aa, Artificial Sequence
  Synthetic polypeptide
EINHAGQTNYNPSLKS

SEQ ID NO: 635 - protein, 11 aa, Artificial Sequence
  Synthetic polypeptide
  MISC_FEATURE (6)..(6): Each Xaa is independently M, G, A, V, I, or L
  MISC_FEATURE (11)..(11): Each Xaa is independently M, G, A, V, I, or L
RTSQDXRDDLX

SEQ ID NO: 636 - protein, 7 aa, Artificial Sequence
  Synthetic polypeptide
  MISC_FEATURE (2)..(2): Each Xaa is independently M, G, A, V, I, or L
DXSSLQS

SEQ ID NO: 637 - protein, 9 aa, Artificial Sequence
  Synthetic polypeptide
  MISC_FEATURE (1)..(1): Each Xaa is independently M, G, A, V, I, or L
XQHQSYPPT

SEQ ID NO: 638 - protein, 9 aa, Artificial Sequence
  Synthetic polypeptide
  MISC_FEATURE (1)..(1): Each Xaa is independently M, G, A, V, I, or L
  MISC_FEATURE (5)..(5): Each Xaa is independently A, C, D, E, F, I, K, L, M, N, P, Q, R, V, W, or Y
  MISC_FEATURE (5)..(5): Xaa may be A, C, D, E, F, I, K, L, M, N, P, Q, R, V, W, or Y
XQHNXYPPT

SEQ ID NO: 639 - protein, 5 aa, Artificial Sequence
  Synthetic polypeptide
  MISC_FEATURE (3)..(4): Each Xaa is independently M, G, A, V, I, or L
SYXXH

SEQ ID NO: 640 - protein, 17 aa, Artificial Sequence
  Synthetic polypeptide
  MISC_FEATURE (1)..(2): Each Xaa is independently M, G, A, V, I, or L
  MISC_FEATURE (6)..(6): Each Xaa is independently M, G, A, V, I, or L
  MISC_FEATURE (10)..(10): Each Xaa is independently M, G, A, V, I, or L
  MISC_FEATURE (14)..(15): Each Xaa is independently M, G, A, V, I, or L
  MISC_FEATURE (17)..(17): Each Xaa is independently M, G, A, V, I, or L
XXSYDXNNKXYTDXXKX

SEQ ID NO: 641 - protein, 13 aa, Artificial Sequence
  Synthetic polypeptide
  MISC_FEATURE (3)..(3): Each Xaa is independently M, G, A, V, I, or L
  MISC_FEATURE (5)..(5): Each Xaa is independently M, G, A, V, I, or L
  MISC_FEATURE (10)..(11): Each Xaa is independently M, G, A, V, I, or L
PTXTXYYYYXXDV

SEQ ID NO: 642 - protein, 11 aa, Artificial Sequence
  Synthetic polypeptide
  MISC_FEATURE (2)..(2): Each Xaa is independently M, G, A, V, I, or L
  MISC_FEATURE (6)..(6): Each Xaa is independently M, G, A, V, I, or L
RXSQSXNNYLN

SEQ ID NO: 643 - protein, 7 aa, Artificial Sequence
  Synthetic polypeptide
  MISC_FEATURE (1)..(1): Each Xaa is independently M, G, A, V, I, or L
  MISC_FEATURE (5)..(5): Each Xaa is independently M, G, A, V, I, or L
XTSSXQS

SEQ ID NO: 644 - protein, 16 aa, Artificial Sequence
  Synthetic polypeptide
  MISC_FEATURE (2)..(2): Each Xaa is independently M, G, A, V, I, or L
  MISC_FEATURE (6)..(6): Each Xaa is independently M, G, A, V, I, or L
  MISC_FEATURE (14)..(14): Each Xaa is independently M, G, A, V, I, or L
YXYYSXSTNYNPSXKS

SEQ ID NO: 645 - protein, 10 aa, Artificial Sequence
  Synthetic polypeptide
  MISC_FEATURE (2)..(3): Each Xaa is independently M, G, A, V, I, or L
  MISC_FEATURE (7)..(7): Each Xaa is independently M, G, A, V, I, or L
EXXSYYXFDY

SEQ ID NO: 646 - protein, 11 aa, Artificial Sequence
  Synthetic polypeptide
  MISC_FEATURE (2)..(3): Each Xaa is independently M, G, A, V, I, or L
  MISC_FEATURE (6)..(6): Each Xaa is independently M, G, A, V, I, or L
  MISC_FEATURE (10)..(10): Each Xaa is independently M, G, A, V, I, or L
RXSQSXNNYXN

SEQ ID NO: 647 - protein, 7 aa, Artificial Sequence
  Synthetic polypeptide
  MISC_FEATURE (1)..(2): Each Xaa is independently M, G, A, V, I, or L
  MISC_FEATURE (5)..(5): Each Xaa is independently M, G, A, V, I, or L
XXSSXQS

SEQ ID NO: 648 - protein, 16 aa, Artificial Sequence
  Synthetic polypeptide
  MISC_FEATURE (2)..(2): Each Xaa is independently M, G, A, V, I, or L
  MISC_FEATURE (6)..(6): Each Xaa is independently M, G, A, V, I, or L
  MISC_FEATURE (14)..(14): Each Xaa is independently M, G, A, V, I, or L
YXYYSXQTKYNPSXKS

SEQ ID NO: 649 - protein, 16 aa, Artificial Sequence
  Synthetic polypeptide
  MISC_FEATURE (2)..(2): Xaa may independently be M, G, A, V, I, or L
  MISC_FEATURE (6)..(6): Xaa may independently be M, G, A, V, I, or L
  MISC_FEATURE (8)..(8): Xaa may be A, C, D, E, F, I, K, L, M, N, P, Q, R, V, W, or Y
  MISC_FEATURE (14)..(14): Xaa may independently be M, G, A, V, I, or L
YXYYSXNXKYNPSXKS

SEQ ID NO: 650 - protein, 10 aa, Artificial Sequence
  Synthetic polypeptide
  MISC_FEATURE (3)..(3): Each Xaa is independently M, G, A, V, I, or L
  MISC_FEATURE (7)..(7): Each Xaa is independently M, G, A, V, I, or L
ETXSYYXFDY

SEQ ID NO: 651 - protein, 17 aa, Artificial Sequence
  Synthetic polypeptide
  MISC_FEATURE (7)..(7): Each Xaa is independently M, G, A, V, I, or L
  MISC_FEATURE (16)..(17): Each Xaa is independently M, G, A, V, I, or L
KSSQSVXYSSNNKNYXX

SEQ ID NO: 652 - protein, 7 aa, Artificial Sequence
  Synthetic polypeptide
  MISC_FEATURE (2)..(2): Each Xaa is independently M, G, A, V, I, or L
WXSTRES

SEQ ID NO: 653 - protein, 9 aa, Artificial Sequence
  Synthetic polypeptide
  MISC_FEATURE (8)..(8): Each Xaa is independently M, G, A, V, I, or L
QQYYKTPXT

SEQ ID NO: 654 - protein, 7 aa, Artificial Sequence
  Synthetic polypeptide
  MISC_FEATURE (3)..(3): Each Xaa is independently A, C, D, E, F, I, K, L, M, N, P, Q, R, V, W, or Y
  MISC_FEATURE (3)..(3): Xaa may be A, C, D, E, F, I, K, L, M, N, P, Q, R, V, W, or Y
  MISC_FEATURE (4)..(5): Each Xaa is independently M, G, A, V, I, or L
TNXXXWN

SEQ ID NO: 655 - protein, 7 aa, Artificial Sequence
  Synthetic polypeptide
  MISC_FEATURE (3)..(3): Xaa may be A, C, D, E, F, I, K, L, M, N, P, Q, R, V, W, or Y
  MISC_FEATURE (4)..(5): Each Xaa is independently M, G, A, V, I, or L
TNXXXWN

SEQ ID NO: 656 - protein, 18 aa, Artificial Sequence
  Synthetic polypeptide
  MISC_FEATURE (13)..(13): Each Xaa is independently M, G, A, V, I, or L
  MISC_FEATURE (16)..(16): Each Xaa is independently M, G, A, V, I, or L
RTYYRSKWYNDYXVSXKS

SEQ ID NO: 657 - protein, 13 aa, Artificial Sequence
  Synthetic polypeptide
  MISC_FEATURE (3)..(3): Each Xaa is independently M, G, A, V, I, or L
  MISC_FEATURE (10)..(11): Each Xaa is independently M, G, A, V, I, or L
EDXDSYYRYXXDV

SEQ ID NO: 658 - protein, 17 aa, Artificial Sequence
  Synthetic polypeptide
  MISC_FEATURE (7)..(7): Each Xaa is independently M, G, A, V, I, or L
  MISC_FEATURE (16)..(17): Each Xaa is independently M, G, A, V, I, or L
RSSQSVXYSSNNKNYXX

SEQ ID NO: 659 - protein, 18 aa, Artificial Sequence
  Synthetic polypeptide
  MISC_FEATURE (13)..(14): Each Xaa is independently M, G, A, V, I, or L
  MISC_FEATURE (16)..(16): Each Xaa is independently M, G, A, V, I, or L
RTYYRSKWYNDYXXSXKS

SEQ ID NO: 660 - protein, 18 aa, Artificial Sequence
  Synthetic polypeptide
  MISC_FEATURE (13)..(14): Each Xaa is independently M, G, A, V, I, or L
  MISC_FEATURE (18)..(18): Each Xaa is independently M, G, A, V, I, or L
RTYYRSKWYNDYXXSVKX

SEQ ID NO: 661 - protein, 12 aa, Artificial Sequence
  Synthetic polypeptide
  MISC_FEATURE (2)..(2): Each Xaa is independently M, G, A, V, I, or L
  MISC_FEATURE (11)..(12): Each Xaa is independently M, G, A, V, I, or L
RXSQSVRSSYXX

SEQ ID NO: 662 - protein, 7 aa, Artificial Sequence
  Synthetic polypeptide
  MISC_FEATURE (1)..(2): Each Xaa is independently M, G, A, V, I, or L
  MISC_FEATURE (6)..(6): Each Xaa is independently M, G, A, V, I, or L
XXSSRXT

SEQ ID NO: 663 - protein, 8 aa, Artificial Sequence
  Synthetic polypeptide
  MISC_FEATURE (4)..(4): Each Xaa is independently M, G, A, V, I, or L
QQYXSSPT

SEQ ID NO: 664 - protein, 5 aa, Artificial Sequence
  Synthetic polypeptide
  MISC_FEATURE (1)..(1): Each Xaa is independently M, G, A, V, I, or L
XYYWN

SEQ ID NO: 665 - protein, 16 aa, Artificial Sequence
  Synthetic pol,ypeptide
  MISC_FEATURE (2)..(2): Each Xaa is independently M, G, A, V, I, or L
  MISC_FEATURE (5)..(6): Each Xaa is independently M, G, A, V, I, or L
  MISC_FEATURE (14)..(14): Each Xaa is independently M, G, A, V, I, or L
EXQHXXQTNYNPSXKS

SEQ ID NO: 666 - protein, 16 aa, Artificial Sequence
  Synthetic polypeptide
  MISC_FEATURE (2)..(2): Each Xaa is independently M, G, A, V, I, or L
  MISC_FEATURE (5)..(6): Each Xaa is independently M, G, A, V, I, or L
  MISC_FEATURE (14)..(14): Each Xaa is independently M, G, A, V, I, or L
EXNHXXNTNYNPSXKS

SEQ ID NO: 667 - protein, 12 aa, Artificial Sequence
  Synthetic polypeptide
  MISC_FEATURE (1)..(1): Each Xaa is independently M, G, A, V, I, or L
XYCRSTTCYFDY

SEQ ID NO: 668 - protein, 12 aa, Artificial Sequence
  Synthetic polypeptide
  MISC_FEATURE (2)..(2): Each Xaa is independently M, G, A, V, I, or L
  MISC_FEATURE (6)..(6): Each Xaa is independently M, G, A, V, I, or L
  MISC_FEATURE (11)..(12): Each Xaa is independently M, G, A, V, I, or L
RXSQSXRSSYXX

SEQ ID NO: 669 - protein, 17 aa, Artificial Sequence
  Synthetic polypeptide
  MISC_FEATURE (1)..(2): Each Xaa is independently M, G, A, V, I, or L
  MISC_FEATURE (6)..(6): Each Xaa is independently M, G, A, V, I, or L
  MISC_FEATURE (10)..(10): Each Xaa is independently M, G, A, V, I, or L
  MISC_FEATURE (12)..(12): Each Xaa is independently M, G, A, V, I, or L
  MISC_FEATURE (15)..(15): Each Xaa is independently M, G, A, V, I, or L
  MISC_FEATURE (17)..(17): Each Xaa is independently M, G, A, V, I, or L
XXSYDXNNKXYXDSXKX

SEQ ID NO: 670 - protein, 10 aa, Artificial Sequence
  Synthetic polypeptide
  MISC_FEATURE (2)..(2): Each Xaa is independently M, G, A, V, I, or L
  MISC_FEATURE (5)..(6): Each Xaa is independently M, G, A, V, I, or L
  MISC_FEATURE (10)..(10): Each Xaa is independently M, G, A, V, I, or L
RXSQXXSNDX

SEQ ID NO: 671 - protein, 14 aa, Artificial Sequence
  Synthetic polypeptide
  MISC_FEATURE (6)..(6): Each Xaa is independently M, G, A, V, I, or L
  MISC_FEATURE (11)..(12): Each Xaa is independently M, G, A, V, I, or L
  MISC_FEATURE (14)..(14): Each Xaa is independently M, G, A, V, I, or L
DETETXYYYYXXDX

SEQ ID NO: 672 - protein, 14 aa, Homo sapiens
GYCSSTSCYTYFDY

SEQ ID NO: 673 - protein, 8 aa, Artificial Sequence
  Synthetic polypeptide
GGGSGGGS

SEQ ID NO: 674 - protein, 9 aa, Homo sapiens
LQHNSYPLT

SEQ ID NO: 675 - protein, 14 aa, Homo sapiens
GTTGTYYYYYGMDV

SEQ ID NO: 676 - protein, 13 aa, Artificial Sequence
  Synthetic polypeptide
  MISC_FEATURE (5)..(5): Each Xaa is independently selected from M, G, A, V, I or L
EDGDXYYRYGMDV

SEQ ID NO: 677 - protein, 16 aa, Artificial Sequence
  Synthetic polypeptide
EIQHAGQTNYNPSLKS

SEQ ID NO: 678 - protein, 17 aa, Artificial Sequence
  Synthetic polypeptide
VISYEGNNKLYTESVKG

SEQ ID NO: 679 - protein, 17 aa, Artificial Sequence
  Synthetic polypeptide
  MISC_FEATURE (1)..(2): Each Xaa is independently selected from M, G, A, V, I or L.
  MISC_FEATURE (6)..(6): Each Xaa is independently selected from M, G, A, V, I or L.
  MISC_FEATURE (15)..(15): Each Xaa is independently selected from M, G, A, V, I or L.
  MISC_FEATURE (17)..(17): Each Xaa is independently selected from M, G, A, V, I or L.
XXSYEXNNKLYTESXKX

SEQ ID NO: 680 - protein, 13 aa, Artificial Sequence
  Synthetic polypeptide
EEGESYYRYGMDV

SEQ ID NO: 681 - protein, 13 aa, Artificial Sequence
  Synthetic polypeptide
  MISC_FEATURE (3)..(3): Each Xaa is independently selected from M, G, A, V, I or L.
  MISC_FEATURE (10)..(11): Each Xaa is independently selected from M, G, A, V, I or L.
  MISC_FEATURE (13)..(13): Each Xaa is independently selected from M, G, A, V, I or L.
EEXESYYRYXXDX

SEQ ID NO: 682 - DNA, 48 bp, Homo sapiens
aggtctagtcagagcctcctgtatagtaatggatacaactatttggat

SEQ ID NO: 683 - protein, 16 aa, Homo sapiens
RSSQSLLYSNGYNYLD

SEQ ID NO: 684 - DNA, 21 bp, Homo sapiens
ttgggttctagtcgggcctcc

SEQ ID NO: 685 - protein, 7 aa, Homo sapiens
LGSSRAS

SEQ ID NO: 686 - DNA, 27 bp, Homo sapiens
atgcaacctctacaaactccgctcact

SEQ ID NO: 687 - protein, 9 aa, Homo sapiens
MQPLQTPLT

SEQ ID NO: 688 - DNA, 51 bp, Homo sapiens
aagtccagtcagaatattttatacagctccaacaataaaaactacttagct

SEQ ID NO: 689 - protein, 17 aa, Homo sapiens
KSSQNILYSSNNKNYLA

SEQ ID NO: 690 - DNA, 21 bp, Homo sapiens
tgggcatctacccgggaatcc

SEQ ID NO: 691 - protein, 17 aa, Artificial Sequence
  Synthetic polypeptide
  MISC_FEATURE (6)..(6): Each Xaa is independently selected from M, G, A, V, I and L.
  MISC_FEATURE (14)..(14): Each Xaa is independently selected from M, G, A, V, I and L.
VMSYDXNNKLYADXVKG

SEQ ID NO: 692 - DNA, 27 bp, Homo sapiens
caacaatattatagtattccgtggacg

SEQ ID NO: 693 - protein, 9 aa, Homo sapiens
QQYYSIPWT

SEQ ID NO: 694 - DNA, 51 bp, Homo sapiens
aagtccagccagagtgttttatacagctccaacaataaaaactacttagct

SEQ ID NO: 695 - protein, 10 aa, Artificial Sequence
  Synthetic polypeptide
GGGGSGGGGS

SEQ ID NO: 696 - DNA, 42 bp, Homo sapiens
actgggagcagctccaacatcggggcaggttataatgttcac

SEQ ID NO: 697 - protein, 14 aa, Homo sapiens
TGSSSNIGAGYNVH

SEQ ID NO: 698 - DNA, 21 bp, Homo sapiens
ggtaacaacaatcggccctca

SEQ ID NO: 699 - protein, 7 aa, Homo sapiens
GNNNRPS

SEQ ID NO: 700 - DNA, 33 bp, Homo sapiens
cagtcctatgacagcagcctgagtggttgggtg

SEQ ID NO: 701 - protein, 11 aa, Homo sapiens
QSYDSSLSGWV

SEQ ID NO: 702 - DNA, 42 bp, Homo sapiens
actgggagcagctccaacatcggggcaggttatgatgtacac

SEQ ID NO: 703 - protein, 12 aa, Artificial Sequence
  Synthetic polypeptide
GGGSGGGSGGGS

SEQ ID NO: 704 - DNA, 21 bp, Homo sapiens
ggtaacagccatcggccctca

SEQ ID NO: 705 - protein, 7 aa, Homo sapiens
GNSHRPS

SEQ ID NO: 706 - DNA, 33 bp, Homo sapiens
cagtcctatgacagcagcctgagtggttatgtc

SEQ ID NO: 707 - protein, 11 aa, Homo sapiens
QSYDSSLSGYV

SEQ ID NO: 708 - DNA, 42 bp, Homo sapiens
actgggagcggctccaacatcggggcaggttatgatgtacac

SEQ ID NO: 709 - protein, 14 aa, Homo sapiens
TGSGSNIGAGYDVH

SEQ ID NO: 710 - DNA, 21 bp, Homo sapiens
ggtaatagtcatcggccctca

SEQ ID NO: 711 - protein, 17 aa, Artificial Sequence
  Synthetic polypeptide
  MISC_FEATURE (1)..(2): Each Xaa is independently selected from M, G, A, V, I and L.
  MISC_FEATURE (6)..(6): Each Xaa is independently selected from M, G, A, V, I and L.
  MISC_FEATURE (10)..(10): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXSYEXNNKXYXESXKX

SEQ ID NO: 712 - DNA, 33 bp, Homo sapiens
cgggcaagtcagagctttagcagttatttaaat

SEQ ID NO: 713 - protein, 11 aa, Homo sapiens
RASQSFSSYLN

SEQ ID NO: 714 - DNA, 21 bp, Homo sapiens
gctgcatccagtttgcaaagt

SEQ ID NO: 715 - protein, 17 aa, Artificial Sequence
  Synthetic polypeptide
VMSYEGNNKLYAESVKG

SEQ ID NO: 716 - DNA, 27 bp, Homo sapiens
caacagagttacagtacccctcgcagt

SEQ ID NO: 717 - protein, 9 aa, Homo sapiens
QQSYSTPRS

SEQ ID NO: 718 - DNA, 33 bp, Homo sapiens
cgggcaagtcagagcgttaccagctatttaaat

SEQ ID NO: 719 - protein, 11 aa, Homo sapiens
RASQSVTSYLN

SEQ ID NO: 720 - DNA, 21 bp, Homo sapiens
actgcatccagtttgcaaagt

SEQ ID NO: 721 - protein, 7 aa, Homo sapiens
TASSLQS

SEQ ID NO: 722 - DNA, 39 bp, Homo sapiens
tctgaaagcaactccgacatcggaactaatgctgtaaac

SEQ ID NO: 723 - protein, 13 aa, Homo sapiens
SESNSDIGTNAVN

SEQ ID NO: 724 - DNA, 21 bp, Homo sapiens
agtaataataagcggccctca

SEQ ID NO: 725 - protein, 7 aa, Homo sapiens
SNNKRPS

SEQ ID NO: 726 - DNA, 33 bp, Homo sapiens
gcaacatgggatgacaacctcaatggtccgcta

SEQ ID NO: 727 - protein, 11 aa, Homo sapiens
ATWDDNLNGPL

SEQ ID NO: 728 - DNA, 33 bp, Homo sapiens
cgggcaagtcagagcattagcagttatttaaat

SEQ ID NO: 729 - protein, 15 aa, Artificial Sequence
  Synthetic polypeptide
GGGGSGGGGSGGGGS

SEQ ID NO: 730 - DNA, 21 bp, Homo sapiens
gttgcatccagtttgcaaagt

SEQ ID NO: 731 - protein, 7 aa, Homo sapiens
VASSLQS

SEQ ID NO: 732 - DNA, 33 bp, Homo sapiens
caacagagttacagtaatcctcaggagtgcagt

SEQ ID NO: 733 - protein, 11 aa, Homo sapiens
QQSYSNPQECS

SEQ ID NO: 734 - DNA, 33 bp, Homo sapiens
cgggcaagtcagggcattagaaatgacttaggc

SEQ ID NO: 735 - protein, 16 aa, Artificial Sequence
  Synthetic polypeptide
GGGSGGGSGGGSGGGS

SEQ ID NO: 736 - DNA, 21 bp, Homo sapiens
gctgcatccggtttacaaggt

SEQ ID NO: 737 - protein, 7 aa, Homo sapiens
AASGLQG

SEQ ID NO: 738 - DNA, 30 bp, Homo sapiens
ctacagcataatagttaccccacgtggacg

SEQ ID NO: 739 - protein, 10 aa, Homo sapiens
LQHNSYPTWT

SEQ ID NO: 740 - DNA, 33 bp, Homo sapiens
cgggcaagtcagagcattagttactatttaaat

SEQ ID NO: 741 - protein, 11 aa, Homo sapiens
RASQSISYYLN

SEQ ID NO: 742 - DNA, 21 bp, Homo sapiens
gctgcatccagtttacaaagt

SEQ ID NO: 743 - protein, 16 aa, Artificial Sequence
  Synthetic polypeptide
RSSQSLLYSQGYNYLD

SEQ ID NO: 744 - DNA, 24 bp, Homo sapiens
caacagagttacagttccatcacc

SEQ ID NO: 745 - protein, 8 aa, Homo sapiens
QQSYSSIT

SEQ ID NO: 746 - DNA, 33 bp, Homo sapiens
cgggcaagtcagaacattagcagctatttaaat

SEQ ID NO: 747 - protein, 11 aa, Homo sapiens
RASQNISSYLN

SEQ ID NO: 748 - DNA, 21 bp, Homo sapiens
actgcatccagtttgcaaagt

SEQ ID NO: 749 - protein, 7 aa, Homo sapiens
TASSLQS

SEQ ID NO: 750 - DNA, 33 bp, Homo sapiens
caacagagttacagtaaccctcctgagagcagt

SEQ ID NO: 751 - protein, 11 aa, Homo sapiens
QQSYSNPPESS

SEQ ID NO: 752 - DNA, 48 bp, Homo sapiens
aggtctagtcaaagcctcgtatacagtgacggaaacacctacttgaat

SEQ ID NO: 753 - protein, 16 aa, Homo sapiens
RSSQSLVYSDGNTYLN

SEQ ID NO: 754 - DNA, 21 bp, Homo sapiens
aaggtttctaactgggactct

SEQ ID NO: 755 - protein, 7 aa, Homo sapiens
KVSNWDS

SEQ ID NO: 756 - DNA, 21 bp, Homo sapiens
atgcaaggtacacactggcct

SEQ ID NO: 757 - protein, 7 aa, Homo sapiens
MQGTHWP

SEQ ID NO: 758 - DNA, 33 bp, Homo sapiens
cgggcaagtcagagcattagcagctatttaaat

SEQ ID NO: 759 - protein, 16 aa, Artificial Sequence
  Synthetic polypeptide
  MISC_FEATURE (6)..(7): Each Xaa is independently selected from M, G, A, V, I and L.
  MISC_FEATURE (11)..(11): Each Xaa is independently selected from M, G, A, V, I and L.
  MISC_FEATURE (15)..(15): Each Xaa is independently selected from M, G, A, V, I and L.
RSSQSXXYSNXYNYXD

SEQ ID NO: 760 - DNA, 21 bp, Homo sapiens
gctgcatccaggttgcaaagt

SEQ ID NO: 761 - protein, 7 aa, Homo sapiens
AASRLQS

SEQ ID NO: 762 - DNA, 27 bp, Homo sapiens
caacagagtgacagtaccccgatcacc

SEQ ID NO: 763 - protein, 9 aa, Homo sapiens
QQSDSTPIT

SEQ ID NO: 764 - DNA, 21 bp, Homo sapiens
gctgcatccagtttacaaagt

SEQ ID NO: 765 - protein, 16 aa, Artificial Sequence
  Synthetic polypeptide
  MISC_FEATURE (6)..(7): Each Xaa is independently selected from M, G, A, V, I and L.
  MISC_FEATURE (11)..(11): Each Xaa is independently selected from M, G, A, V, I and L.
  MISC_FEATURE (15)..(15): Each Xaa is independently selected from M, G, A, V, I and L.
RSSQSXXYSQXYNYXD

SEQ ID NO: 766 - DNA, 24 bp, Homo sapiens
caacagagtttcagtaccatcacc

SEQ ID NO: 767 - protein, 8 aa, Homo sapiens
QQSFSTIT

SEQ ID NO: 768 - DNA, 21 bp, Homo sapiens
ggtgcatcccgtttgcaaagt

SEQ ID NO: 769 - protein, 7 aa, Homo sapiens
GASRLQS

SEQ ID NO: 770 - DNA, 27 bp, Homo sapiens
caacagagtgacactaccccgatcacc

SEQ ID NO: 771 - protein, 9 aa, Homo sapiens
QQSDTTPIT

SEQ ID NO: 772 - DNA, 33 bp, Homo sapiens
cgggcaagtcagagcattagccactatttaaat

SEQ ID NO: 773 - protein, 11 aa, Homo sapiens
RASQSISHYLN

SEQ ID NO: 774 - DNA, 24 bp, Homo sapiens
caacagagtttcagtagcatcacc

SEQ ID NO: 775 - protein, 8 aa, Homo sapiens
QQSFSSIT

SEQ ID NO: 776 - DNA, 15 bp, Homo sapiens
acctattacatgagc

SEQ ID NO: 777 - protein, 5 aa, Homo sapiens
TYYMS

SEQ ID NO: 778 - DNA, 51 bp, Homo sapiens
tccattagtagtagtagtagtttcatatactacgcagactcagtgaagggc

SEQ ID NO: 779 - protein, 17 aa, Homo sapiens
SISSSSSFIYYADSVKG

SEQ ID NO: 780 - DNA, 48 bp, Homo sapiens
gaccgtatagcagcacctggtacatactactactacggtatggacgtc

SEQ ID NO: 781 - protein, 16 aa, Homo sapiens
DRIAAPGTYYYYGMDV

SEQ ID NO: 782 - DNA, 15 bp, Homo sapiens
acttatggcatgcac

SEQ ID NO: 783 - protein, 5 aa, Homo sapiens
TYGMH

SEQ ID NO: 784 - DNA, 51 bp, Homo sapiens
gttatttggtatgatggaagtaataaagactatgcagactccgtgaagggc

SEQ ID NO: 785 - protein, 17 aa, Homo sapiens
VIWYDGSNKDYADSVKG

SEQ ID NO: 786 - DNA, 39 bp, Homo sapiens
gaggaaagggattcgtactaccattacgggatggacgtc

SEQ ID NO: 787 - protein, 13 aa, Homo sapiens
EERDSYYHYGMDV

SEQ ID NO: 788 - DNA, 15 bp, Homo sapiens
agttatggcatgcac

SEQ ID NO: 789 - protein, 7 aa, Artificial Sequence
  Synthetic polypeptide
  MISC_FEATURE (1)..(2): Each Xaa is independently selected from M, G, A, V, I and L.
  MISC_FEATURE (6)..(6): Each Xaa is independently selected from M, G, A, V, I and L.
XXSSRXS

SEQ ID NO: 790 - DNA, 39 bp, Homo sapiens
gaggaaagggattcctactaccactacggtatggacgtc

SEQ ID NO: 791 - DNA, 15 bp, Homo sapiens
agctatgtcatgagc

SEQ ID NO: 792 - protein, 5 aa, Homo sapiens
SYVMS

SEQ ID NO: 793 - DNA, 51 bp, Homo sapiens
gttattagtggtagtggtggtagcacatactacgcagactccgtgaagggc

SEQ ID NO: 794 - protein, 17 aa, Homo sapiens
VISGSGGSTYYADSVKG

SEQ ID NO: 795 - DNA, 42 bp, Homo sapiens
ggtggtaccaactattactactactactccggtatggacgtc

SEQ ID NO: 796 - protein, 14 aa, Homo sapiens
GGTNYYYYYSGMDV

SEQ ID NO: 797 - DNA, 15 bp, Homo sapiens
aactatgccatgagc

SEQ ID NO: 798 - protein, 5 aa, Homo sapiens
NYAMS

SEQ ID NO: 799 - DNA, 51 bp, Homo sapiens
gttattagtggtagaggtggtagcacatactacgcagactccgtgaagggc

SEQ ID NO: 800 - protein, 17 aa, Homo sapiens
VISGRGGSTYYADSVKG

SEQ ID NO: 801 - DNA, 33 bp, Homo sapiens
gacgggtatagcagtgcctggtactttgactac

SEQ ID NO: 802 - protein, 11 aa, Homo sapiens
DGYSSAWYFDY

SEQ ID NO: 803 - DNA, 15 bp, Homo sapiens
aactatgccatgaac

SEQ ID NO: 804 - protein, 5 aa, Homo sapiens
NYAMN

SEQ ID NO: 805 - DNA, 51 bp, Homo sapiens
gtcattagtggtcgtggtggtagtacatactatgcagactccgtgaagggc

SEQ ID NO: 806 - DNA, 33 bp, Homo sapiens
gacgggtatagcagtgcctggttctttgactac

SEQ ID NO: 807 - protein, 11 aa, Homo sapiens
DGYSSAWFFDY

SEQ ID NO: 808 - DNA, 21 bp, Homo sapiens
agcagcagtgctacttggaac

SEQ ID NO: 809 - protein, 7 aa, Homo sapiens
SSSATWN

SEQ ID NO: 810 - DNA, 54 bp, Homo sapiens
aggacataccagaggtccaagtggaataatgattatgcagtatctgtgaaaagt

SEQ ID NO: 811 - protein, 18 aa, Homo sapiens
RTYQRSKWNNDYAVSVKS

SEQ ID NO: 812 - DNA, 33 bp, Homo sapiens
gaagtagtggctggcccgaggtggttcgacccc

SEQ ID NO: 813 - protein, 11 aa, Homo sapiens
EVVAGPRWFDP

SEQ ID NO: 814 - DNA, 21 bp, Homo sapiens
agcaacagtgctacttggaac

SEQ ID NO: 815 - protein, 7 aa, Homo sapiens
SNSATWN

SEQ ID NO: 816 - DNA, 54 bp, Homo sapiens
aggacatactacaggtccaagttgtataatgattatgcagtatctgtgaaaagt

SEQ ID NO: 817 - protein, 18 aa, Homo sapiens
RTYYRSKLYNDYAVSVKS

SEQ ID NO: 818 - DNA, 15 bp, Homo sapiens
ggcttctatatgcac

SEQ ID NO: 819 - protein, 5 aa, Homo sapiens
GFYMH

SEQ ID NO: 820 - DNA, 51 bp, Homo sapiens
tggatcaaccctgacagtggtggcacaaactatgcacagaagtttcagggc

SEQ ID NO: 821 - protein, 17 aa, Homo sapiens
WINPDSGGTNYAQKFQG

SEQ ID NO: 822 - DNA, 27 bp, Homo sapiens
gagggtatagcagtggctcttacctac

SEQ ID NO: 823 - protein, 9 aa, Homo sapiens
EGIAVALTY

SEQ ID NO: 824 - DNA, 15 bp, Homo sapiens
ggttactactggagc

SEQ ID NO: 825 - protein, 20 aa, Artificial Sequence
  Synthetic polypeptide
GGGGSGGGGSGGGGSGGGGS

SEQ ID NO: 826 - DNA, 48 bp, Homo sapiens
gaaatcaatcatagtggaagaaccaactacaacccgtccctcaagagt

SEQ ID NO: 827 - protein, 16 aa, Homo sapiens
EINHSGRTNYNPSLKS

SEQ ID NO: 828 - DNA, 30 bp, Homo sapiens
gacagtggctggcacttttcttttgatatc

SEQ ID NO: 829 - protein, 10 aa, Homo sapiens
DSGWHFSFDI

SEQ ID NO: 830 - DNA, 15 bp, Homo sapiens
agctatggcatgcac

SEQ ID NO: 831 - DNA, 51 bp, Homo sapiens
gttatatggtttgatggaagtaatgaatactatgcagactccgtgaagggc

SEQ ID NO: 832 - protein, 17 aa, Homo sapiens
VIWFDGSNEYYADSVKG

SEQ ID NO: 833 - DNA, 30 bp, Homo sapiens
gagcgatggttcggggagttattagactac

SEQ ID NO: 834 - protein, 10 aa, Homo sapiens
ERWFGELLDY

SEQ ID NO: 835 - DNA, 15 bp, Homo sapiens
agctatgccatgagc

SEQ ID NO: 836 - protein, 5 aa, Homo sapiens
SYAMS

SEQ ID NO: 837 - DNA, 51 bp, Homo sapiens
ggtattagtggtggtggtggtagcacatactacgcagactccgtgaagggc

SEQ ID NO: 838 - protein, 17 aa, Homo sapiens
GISGGGGSTYYADSVKG

SEQ ID NO: 839 - DNA, 24 bp, Homo sapiens
gaaatggctggggcttttgatatc

SEQ ID NO: 840 - protein, 8 aa, Homo sapiens
EMAGAFDI

SEQ ID NO: 841 - DNA, 15 bp, Homo sapiens
gggtactactggagc

SEQ ID NO: 842 - DNA, 48 bp, Homo sapiens
gaaatcaatcctgttggaagaaccaactacaaaccgtccctcaagagt

SEQ ID NO: 843 - protein, 16 aa, Homo sapiens
EINPVGRTNYKPSLKS

SEQ ID NO: 844 - DNA, 30 bp, Homo sapiens
gacaatgggtggcactatgcttttgatatc

SEQ ID NO: 845 - protein, 10 aa, Homo sapiens
DNGWHYAFDI

SEQ ID NO: 846 - DNA, 15 bp, Homo sapiens
gcctactatatgcac

SEQ ID NO: 847 - protein, 5 aa, Homo sapiens
AYYMH

SEQ ID NO: 848 - DNA, 51 bp, Homo sapiens
tggatcaaccctaacagtggtggcacaaactatgcacagaagtttcggggc

SEQ ID NO: 849 - protein, 17 aa, Homo sapiens
WINPNSGGTNYAQKFRG

SEQ ID NO: 850 - DNA, 27 bp, Homo sapiens
ggcggcagctgggagggttttgactac

SEQ ID NO: 851 - protein, 9 aa, Homo sapiens
GGSWEGFDY

SEQ ID NO: 852 - DNA, 51 bp, Homo sapiens
ggtattagtggtagtggtggtagcagatactacgcagactccgtgaagggc

SEQ ID NO: 853 - protein, 17 aa, Homo sapiens
GISGSGGSRYYADSVKG

SEQ ID NO: 854 - DNA, 24 bp, Homo sapiens
gaagtggctggggcttttgatatc

SEQ ID NO: 855 - protein, 8 aa, Homo sapiens
EVAGAFDI

SEQ ID NO: 856 - DNA, 15 bp, Homo sapiens
ggctactatatgcac

SEQ ID NO: 857 - protein, 5 aa, Homo sapiens
GYYMH

SEQ ID NO: 858 - DNA, 51 bp, Homo sapiens
tggatcatccctaacagtggtggcacaaattatgcccagaagtttcagggc

SEQ ID NO: 859 - protein, 17 aa, Homo sapiens
WIIPNSGGTNYAQKFQG

SEQ ID NO: 860 - DNA, 27 bp, Homo sapiens
ggcagcagctgggagggatttgactac

SEQ ID NO: 861 - protein, 9 aa, Homo sapiens
GSSWEGFDY

SEQ ID NO: 862 - DNA, 15 bp, Homo sapiens
agttatgccatgagt

SEQ ID NO: 863 - DNA, 51 bp, Homo sapiens
ggtattagtggtagaggtggtagcacatactacgcagactccgtgaagggc

SEQ ID NO: 864 - protein, 17 aa, Homo sapiens
GISGRGGSTYYADSVKG

SEQ ID NO: 865 - DNA, 339 bp, Homo sapiens
gatattgtgatgactcagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctagtcgggcctccggggtccctgacaggttcagtggcagtggatcaggcacagattttacactgaaaatcagcagagtggaggctgaggatgttggggtttattactgcatgcaacctctacaaactccgctcactttcggcggagggaccaaggtggagatcaaacga

SEQ ID NO: 866 - protein, 112 aa, Homo sapiens
DIVMTQSPLSLPVTPGEPASISCRSSQSLLYSNGYNYLDWYLQKPGQSPQLLIYLGSSRASGVPDRFSGSGSGTDFTLKISRVEAEDVGVYYCMQPLQTPLTFGGGTKVEIK

SEQ ID NO: 867 - DNA, 375 bp, Homo sapiens
gaggtgcagctggtggagtctgggggaggcctggtcaagcctggggggtccctgagactctcctgtgcagcctctgaattcaccttcagtacctattacatgagctgggtccgccaggctccagggaaggggctggagtgggtctcatccattagtagtagtagtagtttcatatactacgcagactcagtgaagggccgattcaccatctccagagacaacgccaagaactcactgtatctgcaaatgaacagcctgagagccgaggacacggctgtatattactgtgcgagagaccgtatagcagcacctggtacatactactactacggtatggacgtctggggccaagggaccacggtcaccgtctcctca

SEQ ID NO: 868 - protein, 125 aa, Homo sapiens
EVQLVESGGGLVKPGGSLRLSCAASEFTFSTYYMSWVRQAPGKGLEWVSSISSSSSFIYYADSVKGRFTISRDNAKNSLYLQMNSLRAEDTAVYYCARDRIAAPGTYYYYGMDVWGQGTTVTVSS

SEQ ID NO: 869 - DNA, 342 bp, Homo sapiens
gacatcgtgatgacccagtctccagactccctggctgtgtctctgggcgagagggccaccatcaactgcaagtccagtcagaatattttatacagctccaacaataaaaactacttagcttggtaccagcagaaaccaggacagcctcctagcctgctcatttactgggcatctacccgggaatccggggtccctgaccgattcagtggcagcgggtctgggacagatttcactctcaccctcagcagcctgcaggctgaagatgtggcagtttatttctgtcaacaatattatagtattccgtggacgttcggccaagggaccaaggtggaaatcaaacga

SEQ ID NO: 870 - protein, 113 aa, Homo sapiens
DIVMTQSPDSLAVSLGERATINCKSSQNILYSSNNKNYLAWYQQKPGQPPSLLIYWASTRESGVPDRFSGSGSGTDFTLTLSSLQAEDVAVYFCQQYYSIPWTFGQGTKVEIK

SEQ ID NO: 871 - DNA, 366 bp, Homo sapiens
caggtgcagttggtggagtctgggggaggcgtggtccagcctgggaggtccctgagactctcctgtgcagcgtctggattcaccttcagtacttatggcatgcactgggtccgccaggctccaggcaaggggctggagtgggtggcagttatttggtatgatggaagtaataaagactatgcagactccgtgaagggccgattcaccgtctccagagacaattccagggacacgttgtatctgcaaatgaacagcctgagagccgaggacacggctgtgtattactgtgcgagagaggaaagggattcgtactaccattacgggatggacgtctggggccaagggaccacggtcaccgtctcttca

SEQ ID NO: 872 - protein, 122 aa, Homo sapiens
QVQLVESGGGVVQPGRSLRLSCAASGFTFSTYGMHWVRQAPGKGLEWVAVIWYDGSNKDYADSVKGRFTVSRDNSRDTLYLQMNSLRAEDTAVYYCAREERDSYYHYGMDVWGQGTTVTVSS

SEQ ID NO: 873 - DNA, 342 bp, Homo sapiens
gacatcgtgatgacccagtctccagactccctgactgtgtctctgggcgagggggccaccatcaactgcaagtccagccagagtgttttatacagctccaacaataaaaactacttagcttggtaccagcagaaaccaggacagcctcctagcctgctcatttactgggcatctacccgggaatccggggtccctgaccgattcagtggcagcgggtctgggacagatttcactctcaccatcagcagcctgcaggctgaagatgtggcagtttattactgtcaacaatattatagtattccgtggacgttcggccaagggaccaaggtggaaatcaaacga

SEQ ID NO: 874 - protein, 113 aa, Homo sapiens
DIVMTQSPDSLTVSLGEGATINCKSSQSVLYSSNNKNYLAWYQQKPGQPPSLLIYWASTRESGVPDRFSGSGSGTDFTLTISSLQAEDVAVYYCQQYYSIPWTFGQGTKVEIK

SEQ ID NO: 875 - DNA, 366 bp, Homo sapiens
caggtgcagttggtggagtctgggggaggcgtggtccagcctgggaggtccctgagactctcctgtgcagcgtctggattcatcttcagtagttatggcatgcactgggtccgccaggctccaggcaaggggctggagtgggtggcagttatttggtatgatggaagtaataaagactatgcagactccgtgaagggccgattcaccgtctccagagacaattccagggacacgttgtatctgcaaatgaacagcctgagagccgaggacacggctgtgtattactgtgcgagagaggaaagggattcctactaccactacggtatggacgtctggggccaagggaccacggtcaccgtctcttca

SEQ ID NO: 876 - protein, 122 aa, Homo sapiens
QVQLVESGGGVVQPGRSLRLSCAASGFIFSSYGMHWVRQAPGKGLEWVAVIWYDGSNKDYADSVKGRFTVSRDNSRDTLYLQMNSLRAEDTAVYYCAREERDSYYHYGMDVWGQGTTVTVSS

SEQ ID NO: 877 - DNA, 336 bp, Homo sapiens
cagtctgtgctgacgcagccgccctcagtgtctggggccccagggcagagggtcaccatctcctgcactgggagcagctccaacatcggggcaggttataatgttcactggtaccagcagcttccaggaacagcccccaaactcctcatctatggtaacaacaatcggccctcaggggtccctgaccgattctctggctccaagtctggcacctcagcctccctggccatcactggactccagactgaggatgaggctgattattactgccagtcctatgacagcagcctgagtggttgggtgttcggcggagggaccaagctgaccgtcctaggt

SEQ ID NO: 878 - protein, 111 aa, Homo sapiens
QSVLTQPPSVSGAPGQRVTISCTGSSSNIGAGYNVHWYQQLPGTAPKLLIYGNNNRPSGVPDRFSGSKSGTSASLAITGLQTEDEADYYCQSYDSSLSGWVFGGGTKLTVL

SEQ ID NO: 879 - DNA, 369 bp, Homo sapiens
gaaatacagctgttggagtctgggggaggcttggtacagcctggggggtccctgagactttcctgtgtagcctctggattcacctttagcagctatgtcatgagctgggtccgccaggctccagggaaggggctggagtgggtctcagttattagtggtagtggtggtagcacatactacgcagactccgtgaagggccggttcaccatctccagagacaattccaagaccacgctgtatctgcaaatgaacagcctgagagccgaggacacggccgtatattactgtgcgaaaggtggtaccaactattactactactactccggtatggacgtctggggccaagggaccacggtcaccgtctcctca

SEQ ID NO: 880 - protein, 123 aa, Homo sapiens
EIQLLESGGGLVQPGGSLRLSCVASGFTFSSYVMSWVRQAPGKGLEWVSVISGSGGSTYYADSVKGRFTISRDNSKTTLYLQMNSLRAEDTAVYYCAKGGTNYYYYYSGMDVWGQGTTVTVSS

SEQ ID NO: 881 - DNA, 336 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagccatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggt

SEQ ID NO: 882 - protein, 111 aa, Homo sapiens
QSVLTQPPSVSGAPGQRVTISCTGSSSNIGAGYDVHWYQQLPGTAPKLLIYGNSHRPSGVPDRFSGSKSGTSASLAITGLQAEDEADYYCQSYDSSLSGYVFGTGTKVTVL

SEQ ID NO: 883 - DNA, 360 bp, Homo sapiens
gaggtgcagctgttggagtctgggggaggcttggtacagcctggggggtccctaagactctcctgtgcagcctctggattcacctttagcaactatgccatgagctgggtccgccaggctccagggaaggggctgcagtgggtctcagttattagtggtagaggtggtagcacatactacgcagactccgtgaagggccggttcaccatctccagagacaactccaagaacacgctgtatctgcaaatgaacagcctgagagccgaggacacggccgtatattactgtgcgaaagacgggtatagcagtgcctggtactttgactactggggccagggaaccctggtcaccgtctcctca

SEQ ID NO: 884 - protein, 120 aa, Homo sapiens
EVQLLESGGGLVQPGGSLRLSCAASGFTFSNYAMSWVRQAPGKGLQWVSVISGRGGSTYYADSVKGRFTISRDNSKNTLYLQMNSLRAEDTAVYYCAKDGYSSAWYFDYWGQGTLVTVSS

SEQ ID NO: 885 - DNA, 336 bp, Homo sapiens
cagtctgtgctgacgcagccgccctcagtgtctggggccccagggcagagggtcaccatctcctgcactgggagcggctccaacatcggggcaggttatgatgtacactggtaccagcagcttccaggaacagcccccaaactcctcatctatggtaatagtcatcggccctcagggatccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggt

SEQ ID NO: 886 - protein, 111 aa, Homo sapiens
QSVLTQPPSVSGAPGQRVTISCTGSGSNIGAGYDVHWYQQLPGTAPKLLIYGNSHRPSGIPDRFSGSKSGTSASLAITGLQAEDEADYYCQSYDSSLSGYVFGTGTKVTVL

SEQ ID NO: 887 - DNA, 360 bp, Homo sapiens
gaggtgcagctgttggaatctgggggaggcttggtacagccgggggggtccctgagactctcctgtgcagcctctggattcacctttagcaactatgccatgaactgggtccgccaggctccagggaaggggctggagtgggtctcagtcattagtggtcgtggtggtagtacatactatgcagactccgtgaagggccggttcaccatctccagagacaattccaggaacacgctgtatctgcaaatgaacagcctgagagccgaggacacggccatatattactgtgcgaaagacgggtatagcagtgcctggttctttgactactggggccagggaaccctgatcaccgtctcctca

SEQ ID NO: 888 - protein, 120 aa, Homo sapiens
EVQLLESGGGLVQPGGSLRLSCAASGFTFSNYAMNWVRQAPGKGLEWVSVISGRGGSTYYADSVKGRFTISRDNSRNTLYLQMNSLRAEDTAIYYCAKDGYSSAWFFDYWGQGTLITVSS

SEQ ID NO: 889 - DNA, 324 bp, Homo sapiens
gacatccagatgacccagtctccatcctccctgtctgcatctgtaggagacagagtcaccatcacttgccgggcaagtcagagctttagcagttatttaaattggtatcagcagaaaccagggaaagcccctgagctcctgatctatgctgcatccagtttgcaaagtggggtcccatcaaggttcagtggcagtggatctgggacagatttcactctcaccatcagcagtctgcaacctgaagattttgcaagttacttctgtcaacagagttacagtacccctcgcagttttggccaggggaccaagctggagatcaaacga

SEQ ID NO: 890 - protein, 107 aa, Homo sapiens
DIQMTQSPSSLSASVGDRVTITCRASQSFSSYLNWYQQKPGKAPELLIYAASSLQSGVPSRFSGSGSGTDFTLTISSLQPEDFASYFCQQSYSTPRSFGQGTKLEIK

SEQ ID NO: 891 - DNA, 369 bp, Homo sapiens
caggtacaactgcagcagtcaggtccaggactggtgaagccctcgcagaccctctcactcacctgtgccatctccggggacagtgtctctagcagcagtgctacttggaactggatcaggcagtccccatcgagaggccttgagtggctgggaaggacataccagaggtccaagtggaataatgattatgcagtatctgtgaaaagtcgaataaccatcaacccagacacatccaggaaccagttctccctgcagctgaactctgtgactcccgaggacacggctgtgtattactgtgcaagagaagtagtggctggcccgaggtggttcgacccctggggccagggaaccctggtcaccgtctcctca

SEQ ID NO: 892 - protein, 123 aa, Homo sapiens
QVQLQQSGPGLVKPSQTLSLTCAISGDSVSSSSATWNWIRQSPSRGLEWLGRTYQRSKWNNDYAVSVKSRITINPDTSRNQFSLQLNSVTPEDTAVYYCAREVVAGPRWFDPWGQGTLVTVSS

SEQ ID NO: 893 - DNA, 324 bp, Homo sapiens
gacatccagatgacccagtctccatcctccctgtctgcatctgtaggagacagagtcaccatcacttgccgggcaagtcagagcgttaccagctatttaaattggtatcagcagaaaccagggaaagcccctaaactcctgatctatactgcatccagtttgcaaagtgggatcccatcaaggttcagtggcagtggatctgggacagatttcactctcaccatcagcagtctgcaacctgaagattttgcaacttacttctgtcaacagagttacagtacccctcgcagttttggccaggggaccaagctggagatcaaacga

SEQ ID NO: 894 - protein, 107 aa, Homo sapiens
DIQMTQSPSSLSASVGDRVTITCRASQSVTSYLNWYQQKPGKAPKLLIYTASSLQSGIPSRFSGSGSGTDFTLTISSLQPEDFATYFCQQSYSTPRSFGQGTKLEIK

SEQ ID NO: 895 - DNA, 369 bp, Homo sapiens
caggtacagctgcagcagtcaggtccaggactggtgaagccctcgcagaccctctcactcacctgtgccatctccggggacagtgtctctagcaacagtgctacttggaactggatcaggcagtccccatcgagaggccttgagtggctgggaaggacatactacaggtccaagttgtataatgattatgcagtatctgtgaaaagtcgaataaccatcaacccagacacatccaagaaccagttctccctgcagctgaactctgtgactcccgaggacacggctgtgtattactgtgcaagagaagtagtggctggcccgaggtggttcgacccctggggccagggaaccctggtcaccgtctcctca

SEQ ID NO: 896 - protein, 123 aa, Homo sapiens
QVQLQQSGPGLVKPSQTLSLTCAISGDSVSSNSATWNWIRQSPSRGLEWLGRTYYRSKLYNDYAVSVKSRITINPDTSKNQFSLQLNSVTPEDTAVYYCAREVVAGPRWFDPWGQGTLVTVSS

SEQ ID NO: 897 - DNA, 333 bp, Homo sapiens
cagtctgtgctgactcaaccaccctcagcgtctgggacccccgggcagagggtcaccatctcttgttctgaaagcaactccgacatcggaactaatgctgtaaactggtaccagcagttcccaggaacggcccccaaattcctcatctatagtaataataagcggccctcaggagtccctgaccgattctctggctccaagtctggcacctcagcctccctggccatcagtgggctccagtctgaggatgaggctgattattactgtgcaacatgggatgacaacctcaatggtccgctattcggcggagggaccaagctgaccgtcctaggt

SEQ ID NO: 898 - protein, 110 aa, Homo sapiens
QSVLTQPPSASGTPGQRVTISCSESNSDIGTNAVNWYQQFPGTAPKFLIYSNNKRPSGVPDRFSGSKSGTSASLAISGLQSEDEADYYCATWDDNLNGPLFGGGTKLTVL

SEQ ID NO: 899 - DNA, 354 bp, Homo sapiens
caggtgcaactggtgcagtctggggctgaggtgaagaagcctggggcctcagtgagggtctcctgcaaggcttctggatacaccttcaccggcttctatatgcactgggtgcgacaggcccctggacaagggcttgagtggatgggatggatcaaccctgacagtggtggcacaaactatgcacagaagtttcagggcagggtcaccatgaccagggacacgtccatcagcacagcctacatggagttgagtaggctgagatctgacgacacggccgtatattactgtgcgagagagggtatagcagtggctcttacctactggggccagggaaccctggtcaccgtctcctca

SEQ ID NO: 900 - protein, 118 aa, Homo sapiens
QVQLVQSGAEVKKPGASVRVSCKASGYTFTGFYMHWVRQAPGQGLEWMGWINPDSGGTNYAQKFQGRVTMTRDTSISTAYMELSRLRSDDTAVYYCAREGIAVALTYWGQGTLVTVSS

SEQ ID NO: 901 - DNA, 330 bp, Homo sapiens
gacatccagatgacccagtctccatcctccctgtctgcatctgtaggagacagagtcaccatcacttgccgggcaagtcagagcattagcagttatttaaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtaatcctcaggagtgcagttttggccaggggaccaagctggagatcaaacga

SEQ ID NO: 902 - protein, 109 aa, Homo sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSNPQECSFGQGTKLEIK

SEQ ID NO: 903 - DNA, 354 bp, Homo sapiens
caggagcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagaaccaactacaacccgtccctcaagagtcgagtcaccatatcagtggacacgtccaagaaccagttctccctgaagctgagctctgtgaccgccgcggacacggctgtgtattactgtgcgagggacagtggctggcacttttcttttgatatctgggaccaagggacaatggtcaccgtctcttca

SEQ ID NO: 904 - protein, 118 aa, Homo sapiens
QEQLQQWGAGLLKPSETLSLTCAVYGGSFSGYYWSWIRQPPGKGLEWIGEINHSGRTNYNPSLKSRVTISVDTSKNQFSLKLSSVTAADTAVYYCARDSGWHFSFDIWDQGTMVTVSS

SEQ ID NO: 905 - DNA, 327 bp, Homo sapiens
gacatccagatgacccagtctccatcctccctgtctgcatctgtaggagacagagtcaccatcacttgccgggcaagtcagggcattagaaatgacttaggctggtatcaggagaaaccagggaaagcccctaagcgcctgatctatgctgcatccggtttacaaggtggggacccatcaaggttcagcggcagtggatctgggacagaattcactctcacaatcagcagcctgcagcctgaagattttgcaacttattactgtctacagcataatagttaccccacgtggacgttcggccaagggaccaaggtggaaatcaaacga

SEQ ID NO: 906 - protein, 108 aa, Homo sapiens
DIQMTQSPSSLSASVGDRVTITCRASQGIRNDLGWYQEKPGKAPKRLIYAASGLQGGDPSRFSGSGSGTEFTLTISSLQPEDFATYYCLQHNSYPTWTFGQGTKVEIK

SEQ ID NO: 907 - DNA, 357 bp, Homo sapiens
caggtgcagctggtggagtccggggcaggcgtggtccagcctgggaggtccctgagactctcctgtgcagcgtctggattcaccttcagtagctatggcatgcactgggtccgccaggctccaggcatggggctggagtgggtggcagttatatggtttgatggaagtaatgaatactatgcagactccgtgaagggccgattcaccatctccagagacaattccaagaacacgctgtatctgcaaatgaacagcctgagagccgaggacacggctgtgtattactgtgcgagagagcgatggttcggggagttattagactactggggccagggaaccctggtcaccgtctcctca

SEQ ID NO: 908 - protein, 119 aa, Homo sapiens
QVQLVESGAGVVQPGRSLRLSCAASGFTFSSYGMHWVRQAPGMGLEWVAVIWFDGSNEYYADSVKGRFTISRDNSKNTLYLQMNSLRAEDTAVYYCARERWFGELLDYWGQGTLVTVSS

SEQ ID NO: 909 - DNA, 321 bp, Homo sapiens
gacatccagatgatccagtctccatcctccctgtctgcatctgtaggagacagcgtcaccatcacttgccgggcaagtcagagcattagttactatttaaattggtatcaacagaaaccagggaaagcccctaagttcctgatctatgctgcatccagtttacaaagtggggtcccatcaaggtttagtggcagtggatctgggacagatttcactctcaccatcagcagtctgcaacctgaagattttgcaacttactactgtcaacagagttacagttccatcaccttcggccaagggacacgactggagattaaacga

SEQ ID NO: 910 - protein, 106 aa, Homo sapiens
DIQMIQSPSSLSASVGDSVTITCRASQSISYYLNWYQQKPGKAPKFLIYAASSLQSGVPSRFSGSGSGTDFTLTISSLQPEDFATYYCQQSYSSITFGQGTRLEIK

SEQ ID NO: 911 - DNA, 351 bp, Homo sapiens
gaggtgcacctgttggagtctgggggaggcttggtacagcctggggggtccctgagactctcctgtgcagcctctggattcacctttagcagctatgccatgagctgggtccgccaggctccagggaaggggctggagtgggtctcaggtattagtggtggtggtggtagcacatactacgcagactccgtgaagggccggttcaccatctccagagacaattccaagaacacgctgtatctgcaaatgaacagcctgagagccgagaacacggccgtatattactgtgcgatagaaatggctggggcttttgatatctggggccaagggacaatggtcaccgtctcttca

SEQ ID NO: 912 - protein, 117 aa, Homo sapiens
EVHLLESGGGLVQPGGSLRLSCAASGFTFSSYAMSWVRQAPGKGLEWVSGISGGGGSTYYADSVKGRFTISRDNSKNTLYLQMNSLRAENTAVYYCAIEMAGAFDIWGQGTMVTVSS

SEQ ID NO: 913 - DNA, 330 bp, Homo sapiens
gacatccagatgacccagtctccatcctccctgtctgcatctgtaggagacagagtcaccatcacttgccgggcaagtcagaacattagcagctatttaaattggtatcagcagagaccagggaaagcccctaacctcctgctctttactgcatccagtttgcaaagtggggtcccatcaaggttcagtggcagtggatctgggacagatttcactctcaccatcaacagtctgcaacctgaggattttgcaacttactactgtcaacagagttacagtaaccctcctgagagcagttttggccaggggaccaagctggagatcaaacga

SEQ ID NO: 914 - protein, 109 aa, Homo sapiens
DIQMTQSPSSLSASVGDRVTITCRASQNISSYLNWYQQRPGKAPNLLLFTASSLQSGVPSRFSGSGSGTDFTLTINSLQPEDFATYYCQQSYSNPPESSFGQGTKLEIK

SEQ ID NO: 915 - DNA, 354 bp, Homo sapiens
caggtgcagctacagcagtggggcgcaggactgttgaagccttcggagaccctgtccctcacctgcgctgtctatggtgggtccttcagtgggtactactggagctggatccgccagcctccagggaaggggctggagtggattggggaaatcaatcctgttggaagaaccaactacaaaccgtccctcaagagtcgagtcaccatatcagtagacacgtccaagaaccagttctccctgaagctgagttctgtgaccgccgcggacacggctctgtattactgtgcgagggacaatgggtggcactatgcttttgatatctggggccaagggacaatggtcaccgtctcttca

SEQ ID NO: 916 - protein, 118 aa, Homo sapiens
QVQLQQWGAGLLKPSETLSLTCAVYGGSFSGYYWSWIRQPPGKGLEWIGEINPVGRTNYKPSLKSRVTISVDTSKNQFSLKLSSVTAADTALYYCARDNGWHYAFDIWGQGTMVTVSS

SEQ ID NO: 917 - DNA, 333 bp, Homo sapiens
gatgttgtgatgactcagtctccactctccctgcccgtcacccttggacagccggcctccatctcctgcaggtctagtcaaagcctcgtatacagtgacggaaacacctacttgaattggtttcagcagaggccaggccgatctccaaggcgcttaatttataaggtttctaactgggactctggggtcccagacagattcagcggcagtgggtcaggcactgattccacactgataatcagcagggtggaggctgaggatgttggggtttattactacatgcaaggtacacactggcctctcggcggagggaccaaggtggagatcaaacga

SEQ ID NO: 918 - protein, 110 aa, Homo sapiens
DVVMTQSPLSLPVTLGQPASISCRSSQSLVYSDGNTYLNWFQQRPGRSPRRLIYKVSNWDSGVPDRFSGSGSGTDSTLIISRVEAEDVGVYYYMQGTHWPLGGGTKVEIK

SEQ ID NO: 919 - DNA, 354 bp, Homo sapiens
cagggacagctggtgcagtctggggctgaggtgaagaagcctggggcctcagtgaaggtctcctgccaggcttctggatacaccttcaccgcctactatatgcactgggtgcgacaggcccctggacaagggcttgagtggatgggttggatcaaccctaacagtggtggcacaaactatgcacagaagtttcggggcagggtcaccatgaccagggacacgtccatcagcacagcctacatggaactgagcaggctgagatctgacgacacggccgtgtattactgtgcgactggcggcagctgggagggttttgactactggggccagggaaccctggtcaccgtctcctca

SEQ ID NO: 920 - protein, 118 aa, Homo sapiens
QGQLVQSGAEVKKPGASVKVSCQASGYTFTAYYMHWVRQAPGQGLEWMGWINPNSGGTNYAQKFRGRVTMTRDTSISTAYMELSRLRSDDTAVYYCATGGSWEGFDYWGQGTLVTVSS

SEQ ID NO: 921 - DNA, 324 bp, Homo sapiens
gacatccagatgacccagtctccatcgtccctgtctgcatctgtaggagacagagtcaccatcacttgccgggcaagtcagagcattagcagctatttaaattggtatcagcagaaaccagggaaagcccctaagttcctgatctatgctgcatccaggttgcaaagtggggtcccatcaaggttcagtggcagtggatctgggacagatttcactctcaccatcagtagtctgcaacctgaagattttgcaacttactactgtcaacagagtgacagtaccccgatcaccttcggccaagggacacgactggagattaaacga

SEQ ID NO: 922 - protein, 107 aa, Homo sapiens
DIQMTQSPSSLSASVGDRVTITCRASQSISSYLNWYQQKPGKAPKFLIYAASRLQSGVPSRFSGSGSGTDFTLTISSLQPEDFATYYCQQSDSTPITFGQGTRLEIK

SEQ ID NO: 923 - DNA, 321 bp, Homo sapiens
gacatccagatgatccagtctccatcctccctgtctgcatctgtaggagacagagtcaccatcacttgccgggcaagtcagagcattagcagctatttaaattggtatcaacagaaaccagggaaagcccctaaattcctgatctatgctgcatccagtttacaaagtggggtcccttcaaggtttagtggcagtgggtctgggacagatttcactctcaccatcagcagtctgcaacctgaagattttgcaacttactactgtcaacagagtttcagtaccatcaccttcggccaagggacacgactggagattaaacga

SEQ ID NO: 924 - protein, 106 aa, Homo sapiens
DIQMIQSPSSLSASVGDRVTITCRASQSISSYLNWYQQKPGKAPKFLIYAASSLQSGVPSRFSGSGSGTDFTLTISSLQPEDFATYYCQQSFSTITFGQGTRLEIK

SEQ ID NO: 925 - DNA, 351 bp, Homo sapiens
gaggtgcagctgttggagtctgggggaggcttggtacagcctggggggtccctgagactctcctgtgtagcctctggattcacctttagtagctatgccatgagctgggtccgccaggctccagggaaggggctggagtgggtctcaggtattagtggtagtggtggtagcagatactacgcagactccgtgaagggccggttcaccatctccagagacaattccaagaacacgctgtatctgcaaatgaacagcctgagagccgaggacacggccgtatattactgtgcgatagaagtggctggggcttttgatatctggggccaagggacaatggtcaccgtctcttca

SEQ ID NO: 926 - protein, 117 aa, Homo sapiens
EVQLLESGGGLVQPGGSLRLSCVASGFTFSSYAMSWVRQAPGKGLEWVSGISGSGGSRYYADSVKGRFTISRDNSKNTLYLQMNSLRAEDTAVYYCAIEVAGAFDIWGQGTMVTVSS

SEQ ID NO: 927 - DNA, 324 bp, Homo sapiens
gacatccagatgacccagtctccatcctccctgtctgcatctgtaggagacagagtcaccatcacttgccgggcaagtcagagcattagcagctatttaaattggtatcagcagaaaccagggacagcccctaagttcctgatctatggtgcatcccgtttgcaaagtggggtcccatcaaggttcagtggcagtggatctgggacagatttcactctcaccatcagcagtctgcaacctgaagactttgcaacttactactgtcaacagagtgacactaccccgatcaccttcggccaagggacacgactggagattaaacga

SEQ ID NO: 928 - protein, 107 aa, Homo sapiens
DIQMTQSPSSLSASVGDRVTITCRASQSISSYLNWYQQKPGTAPKFLIYGASRLQSGVPSRFSGSGSGTDFTLTISSLQPEDFATYYCQQSDTTPITFGQGTRLEIK

SEQ ID NO: 929 - DNA, 354 bp, Homo sapiens
caggtgcagctggtgcaatctggggctgaggtgaagaagcctggggcctcagtgcaggtctcctgcaaggcttctggatacaccttcaccggctactatatgcactggattcgacaggcccctgggcaagggcttgagtggctgggatggatcatccctaacagtggtggcacaaattatgcccagaagtttcagggcagggtcaccatgaccagggacacgtccatcagcacagcctacatggaactgagcaggctgagatctgacgacacggccgtttattactgtgcgactggcagcagctgggagggatttgactactggggccagggaaccctggtcaccgtctcctca

SEQ ID NO: 930 - protein, 118 aa, Homo sapiens
QVQLVQSGAEVKKPGASVQVSCKASGYTFTGYYMHWIRQAPGQGLEWLGWIIPNSGGTNYAQKFQGRVTMTRDTSISTAYMELSRLRSDDTAVYYCATGSSWEGFDYWGQGTLVTVSS

SEQ ID NO: 931 - DNA, 321 bp, Homo sapiens
gacatccagatgatccagtctccatcctccctgtctgcatctgtaggagacagagtcaccatcacttgccgggcaagtcagagcattagccactatttaaattggtatcagcagaaaccagggaaagcccctaagttcctgatctatgctgcatccagtttacaaagtggggtcccatcaaggtttagtggcagtggatctgggacagatttcactctcaccatcagcagtctgcaacctgaagattttgcaacttactactgtcaacagagtttcagtagcatcaccttcggccaagggacacgactggagattaaacga

SEQ ID NO: 932 - protein, 106 aa, Homo sapiens
DIQMIQSPSSLSASVGDRVTITCRASQSISHYLNWYQQKPGKAPKFLIYAASSLQSGVPSRFSGSGSGTDFTLTISSLQPEDFATYYCQQSFSSITFGQGTRLEIK

SEQ ID NO: 933 - DNA, 351 bp, Homo sapiens
gaggtgcacctgttggagtctgggggaggcttggtacagccgggggggtccctgagactctcttgtgcagcctctggattcacctttagcagttatgccatgagttgggtccgccaggttccagggaaggggctggagtgggtctcaggtattagtggtagaggtggtagcacatactacgcagactccgtgaagggccggttcaccatctccagagacaattccaagaacacgctgtatctgcaaatggacagcctgagagccgaggacacggccgtatataactgtgcgatagaagtggctggggcttttgatatctggggccaagggacaatggtcaccgtctcttca

SEQ ID NO: 934 - protein, 117 aa, Homo sapiens
EVHLLESGGGLVQPGGSLRLSCAASGFTFSSYAMSWVRQVPGKGLEWVSGISGRGGSTYYADSVKGRFTISRDNSKNTLYLQMDSLRAEDTAVYNCAIEVAGAFDIWGQGTMVTVSS

SEQ ID NO: 935 - protein, 7 aa, Homo sapiens
  MISC_FEATURE: CDR sequence of anti-TL1A-antibodies
LGSNRAS

SEQ ID NO: 936 - protein, 9 aa, Homo sapiens
  MISC_FEATURE: CDR sequence of anti-TL1A-antibodies
MQALQTPLT

SEQ ID NO: 937 - protein, 20 aa, Artificial Sequence
  Synthetic polypeptide
GGGSGGGSGGGSGGGSGGGS

SEQ ID NO: 938 - protein, 9 aa, Homo sapiens
  MISC_FEATURE: CDR sequence of anti-TL1A-antibodies
QQYYSTPWT

SEQ ID NO: 939 - protein, 25 aa, Artificial Sequence
  Synthetic polypeptide
GGGGSGGGGSGGGGSGGGGSGGGGS

SEQ ID NO: 940 - protein, 9 aa, Artificial Sequence
  Synthetic polypeptide
  MISC_FEATURE (1)..(1): Each Xaa is independently selected from M, G, A, V, I and L.
  MISC_FEATURE (4)..(4): Each Xaa is independently selected from M, G, A, V, I and L.
  MISC_FEATURE (8)..(8): Each Xaa is independently selected from M, G, A, V, I and L.
XQPXQTPXT

SEQ ID NO: 941 - protein, 24 aa, Artificial Sequence
  Synthetic polypeptide
GGGSGGGSGGGSGGGSGGGSGGGS

SEQ ID NO: 942 - protein, 9 aa, Homo sapiens
  MISC_FEATURE: CDR sequence of anti-TL1A-antibodies
QQSYSTPIT

SEQ ID NO: 943 - protein, 7 aa, Homo sapiens
  MISC_FEATURE: CDR sequence of anti-TL1A-antibodies
KVSNRDS

SEQ ID NO: 944 - protein, 9 aa, Homo sapiens
  MISC_FEATURE: CDR sequence of anti-TL1A-antibodies
MQGTHWPLT

SEQ ID NO: 945 - protein, 25 aa, Artificial Sequence
  Synthetic polypeptide
GGGGSGGGGSGGGGSGGGGSGGGGS

SEQ ID NO: 946 - protein, 9 aa, Artificial Sequence
  Synthetic polypeptide
GGGSGGGGS

SEQ ID NO: 947 - protein, 13 aa, Homo sapiens
  MISC_FEATURE: CDR sequence of anti-TL1A-antibodies
SGSSSNIGSNTVN

SEQ ID NO: 948 - protein, 7 aa, Homo sapiens
  MISC_FEATURE: CDR sequence of anti-TL1A-antibodies
SNNQRPS

SEQ ID NO: 949 - protein, 11 aa, Homo sapiens
AAWDDSLNGVV

SEQ ID NO: 950 - protein, 5 aa, Homo sapiens
  MISC_FEATURE: CDR sequence of anti-TL1A-antibodies
SYSMN

SEQ ID NO: 951 - protein, 17 aa, Homo sapiens
SISSSSSYIYYADSVKG

SEQ ID NO: 952 - protein, 15 aa, Homo sapiens
GIAAAGYYYYYGMDV

SEQ ID NO: 953 - protein, 17 aa, Homo sapiens
  MISC_FEATURE: CDR sequence of anti-TL1A-antibodies
VIWYDGSNKYYADSVKG

SEQ ID NO: 954 - protein, 15 aa, Homo sapiens
  MISC_FEATURE: CDR sequence of anti-TL1A-antibodies
EYSSSSYYYYYGMDV

SEQ ID NO: 955 - protein, 5 aa, Artificial Sequence
  Synthetic polypeptide
  MISC_FEATURE (4)..(4): Each Xaa is independently selected from M, G, A, V, I and L.
TYYXS

SEQ ID NO: 956 - protein, 17 aa, Homo sapiens
  MISC_FEATURE: CDR sequence of anti-TL1A-antibodies
AISGSGGSTYYADSVKG

SEQ ID NO: 957 - DNA, 33 bp, Artificial Sequence; identical to SEQ ID NO: 91
  Synthetic oligonucleotide

SEQ ID NO: 958 - protein, 10 aa, Homo sapiens
  MISC_FEATURE: CDR sequence of anti-TL1A-antibodies
RDGYNYYFDY

SEQ ID NO: 959 - DNA, 21 bp, Artificial Sequence
  Synthetic oligonucleotide
gccgcctcgactcttcagagt

SEQ ID NO: 960 - DNA, 27 bp, Artificial Sequence
  Synthetic oligonucleotide
cagagatacaaccgagcgccttacaca

SEQ ID NO: 961 - protein, 11 aa, Homo sapiens
  MISC_FEATURE: CDR sequence of anti-TL1A-antibodies
GIAVAGNWFDP

SEQ ID NO: 962 - DNA, 42 bp, Artificial Sequence; identical to SEQ ID NO: 145
  Synthetic oligonucleotide

SEQ ID NO: 963 - protein, 17 aa, Homo sapiens
  MISC_FEATURE: CDR sequence of anti-TL1A-antibodies
WINPNSGGTNYAQKFQG

SEQ ID NO: 964 - protein, 11 aa, Homo sapiens
  MISC_FEATURE: CDR sequence of anti-TL1A-antibodies
SIAARAEYFQH

SEQ ID NO: 965 - skipped

SEQ ID NO: 966 - protein, 10 aa, Homo sapiens
  MISC_FEATURE: CDR sequence of anti-TL1A-antibodies
DYGDYDAFDI

SEQ ID NO: 967 - protein, 9 aa, Homo sapiens
  MISC_FEATURE: CDR sequence of anti-TL1A-antibodies
RWLQLYFDY

SEQ ID NO: 968 - protein, 11 aa, Homo sapiens
  MISC_FEATURE: CDR sequence of anti-TL1A-antibodies
VEMATIDAFDI

SEQ ID NO: 969 - protein, 10 aa, Homo sapiens
  MISC_FEATURE: CDR sequence of anti-TL1A-antibodies
GYSYGYYFDY

SEQ ID NO: 970 - protein, 10 aa, Homo sapiens
  MISC_FEATURE: CDR sequence of anti-TL1A-antibodies
SIAARDAFDI

SEQ ID NO: 971 - protein, 17 aa, Artificial Sequence
  Synthetic polypeptide
  MISC_FEATURE (14)..(14): Each Xaa is independently selected from M, G, A, V, I and L.
SISSSSSFIYYADXVKG

SEQ ID NO: 972 - protein, 17 aa, Artificial Sequence
  Synthetic polypeptide
SISSSSSFIYYAESVKG

SEQ ID NO: 973 - protein, 17 aa, Artificial Sequence
  Synthetic polypeptide
  MISC_FEATURE (2)..(2): Each Xaa is independently selected from M, G, A, V, I and L.
  MISC_FEATURE (9)..(9): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
SXSSSSSFXYYXDSXKX

SEQ ID NO: 974 - protein, 17 aa, Artificial Sequence
  Synthetic polypeptide
  MISC_FEATURE (2)..(2): Each Xaa is independently selected from M, G, A, V, I and L.
  MISC_FEATURE (9)..(9): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
SXSSSSSFXYYXESXKX

SEQ ID NO: 975 - protein, 17 aa, Artificial Sequence
  Synthetic polypeptide
  MISC_FEATURE (2)..(2): Each Xaa is independently selected from M, G, A, V, I and L.
  MISC_FEATURE (9)..(9): Each Xaa is independently selected from M, G, A, V, I and L.
  MISC_FEATURE (12)..(12): Each Xaa is independently selected from M, G, A, V, I and L.
  MISC_FEATURE (14)..(15): Each Xaa is independently selected from M, G, A, V, I and L.
  MISC_FEATURE (17)..(17): Each Xaa is independently selected from M, G, A, V, I and L.
SXSSSSSFXYYXDXXKX

SEQ ID NO: 976 - protein, 16 aa, Artificial Sequence
  Synthetic polypeptide
  MISC_FEATURE (3)..(5): Each Xaa is independently selected from M, G, A, V, I and L.
  MISC_FEATURE (7)..(7): Each Xaa is independently selected from M, G, A, V, I and L.
  MISC_FEATURE (13)..(14): Each Xaa is independently selected from M, G, A, V, I and L.
  MISC_FEATURE (16)..(16): Each Xaa is independently selected from M, G, A, V, I and L.
DRXXXPXTYYYYXXDX

SEQ ID NO: 977 - protein, 17 aa, Artificial Sequence
  Synthetic polypeptide
  MISC_FEATURE (6)..(6): Each Xaa is independently selected from M, G, A, V, I and L.
  MISC_FEATURE (16)..(17): Each Xaa is independently selected from M, G, A, V, I and L.
KSSQNXLYSSNNKNYXX

SEQ ID NO: 978 - protein, 9 aa, Artificial Sequence
  Synthetic polypeptide
  MISC_FEATURE (6)..(6): Each Xaa is independently selected from M, G, A, V, I and L.
QQYYSXPWT

SEQ ID NO: 979 - protein, 5 aa, Artificial Sequence
  Synthetic polypeptide
  MISC_FEATURE (3)..(4): Each Xaa is independently selected from M, G, A, V, I and L.
TYXXH

SEQ ID NO: 980 - protein, 17 aa, Artificial Sequence
  Synthetic polypeptide
  MISC_FEATURE (6)..(6): Each Xaa is independently selected from M, G, A, V, I and L.
  MISC_FEATURE (14)..(14): Each Xaa is independently selected from M, G, A, V, I and L.
VIWYDXSNKDYADXVKG

SEQ ID NO: 981 - protein, 17 aa, Artificial Sequence
  Synthetic polypeptide
VIWYEGSNKDYAESVKG

SEQ ID NO: 982 - protein, 17 aa, Artificial Sequence
  Synthetic polypeptide
  MISC_FEATURE (1)..(2): Each Xaa is independently selected from M, G, A, V, I and L.
  MISC_FEATURE (6)..(6): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXWYDXSNKDYXDSXKX

SEQ ID NO: 983 - protein, 17 aa, Artificial Sequence
  Synthetic polypeptide
  MISC_FEATURE (1)..(2): Each Xaa is independently selected from M, G, A, V, I and L.
  MISC_FEATURE (6)..(6): Each Xaa is independently selected from M, G, A, V, I and L.
  MISC_FEATURE (12)..(12): Each Xaa is independently selected from M, G, A, V, I and L.
  MISC_FEATURE (14)..(14): Each Xaa is independently selected from M, G, A, V, I and L.
XXWYDXSNKDYXDXVKG

SEQ ID NO: 984 - protein, 17 aa, Artificial Sequence
  Synthetic polypeptide
  MISC_FEATURE (1)..(2): Each Xaa is independently selected from M, G, A, V, I and L.
  MISC_FEATURE (6)..(6): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
XXWYEXSNKDYXESXKG

SEQ ID NO: 985 - protein, 13 aa, Artificial Sequence
  Synthetic polypeptide
  MISC_FEATURE (10)..(11): Each Xaa is independently selected from M, G, A, V, I and L.
  MISC_FEATURE (13)..(13): Each Xaa is independently selected from M, G, A, V, I and L.
EERDSYYHYXXDX

SEQ ID NO: 986 - protein, 17 aa, Artificial Sequence
  Synthetic polypeptide
  MISC_FEATURE (6)..(7): Each Xaa is independently selected from M, G, A, V, I and L.
  MISC_FEATURE (16)..(17): Each Xaa is independently selected from M, G, A, V, I and L.
KSSQSXXYSSNNKNYXX

SEQ ID NO: 987 - protein, 14 aa, Artificial Sequence
  Synthetic polypeptide
  MISC_FEATURE (2)..(2): Each Xaa is independently selected from M, G, A, V, I and L.
  MISC_FEATURE (7)..(10): Each Xaa is independently selected from M, G, A, V, I and L.
  MISC_FEATURE (13)..(13): Each Xaa is independently selected from M, G, A, V, I and L.
TXSSSNXXXXYNXH

SEQ ID NO: 988 - protein, 7 aa, Artificial Sequence
  Synthetic polypeptide
  MISC_FEATURE (1)..(1): Each Xaa is independently selected from M, G, A, V, I and L.
XNNNRPS

SEQ ID NO: 989 - protein, 11 aa, Artificial Sequence
  Synthetic polypeptide
  MISC_FEATURE (5)..(5): Each Xaa is independently selected from M, G, A, V, I and L.
QSYDXSLSGWV

SEQ ID NO: 990 - protein, 11 aa, Artificial Sequence
  Synthetic polypeptide
QSYESSLSGWV

SEQ ID NO: 991 - protein, 11 aa, Artificial Sequence
  Synthetic polypeptide
  MISC_FEATURE (7)..(7): Each Xaa is independently selected from M, G, A, V, I and L.
  MISC_FEATURE (9)..(9): Each Xaa is independently selected from M, G, A, V, I and L.
  MISC_FEATURE (11)..(11): Each Xaa is independently selected from M, G, A, V, I and L.
QSYDSSXSXWX

SEQ ID NO: 992 - protein, 11 aa, Artificial Sequence
  Synthetic polypeptide
  MISC_FEATURE (5)..(5): Each Xaa is independently selected from M, G, A, V, I and L.
  MISC_FEATURE (7)..(7): Each Xaa is independently selected from M, G, A, V, I and L.
  MISC_FEATURE (9)..(9): Each Xaa is independently selected from M, G, A, V, I and L.
QSYDXSXSXWV

SEQ ID NO: 993 - protein, 11 aa, Artificial Sequence
  Synthetic polypeptide
  MISC_FEATURE (7)..(7): Each Xaa is independently selected from M, G, A, V, I and L.
  MISC_FEATURE (9)..(9): Each Xaa is independently selected from M, G, A, V, I and L.
QSYESSXSXWV

SEQ ID NO: 994 - protein, 5 aa, Artificial Sequence
  Synthetic polypeptide
  MISC_FEATURE (3)..(4): Each Xaa is independently selected from M, G, A, V, I and L.
SYXXS

SEQ ID NO: 995 - protein, 17 aa, Artificial Sequence
  Synthetic polypeptide
  MISC_FEATURE (14)..(14): Each Xaa is independently selected from M, G, A, V, I and L.
VISGSGGSTYYADXVKG

SEQ ID NO: 996 - protein, 17 aa, Artificial Sequence
  Synthetic polypeptide
VISGSGGSTYYAESVKG

SEQ ID NO: 997 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXSXSXXSTYYXDSXKX

SEQ ID NO: 998 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (14)..(15): Each Xaa is independently selected from M, G, A, V, I and L.
  MISC_FEATURE (17)..(17): Each Xaa is independently selected from M, G, A, V, I and L.
XXSXSXXSTYYXDXXKX

SEQ ID NO: 999 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXSXSXXSTYYXESXKX

SEQ ID NO: 1000 - protein, 14 aa, Artificial Sequence
  Synthetic polypeptide
  MISC_FEATURE (1)..(2): Each Xaa is independently selected from M, G, A, V, I and L.
  MISC_FEATURE (11)..(12): Each Xaa is independently selected from M, G, A, V, I and L.
  MISC_FEATURE (14)..(14): Each Xaa is independently selected from M, G, A, V, I and L.
XXTNYYYYYSXXDX

SEQ ID NO: 1001 - protein, 14 aa, Artificial Sequence
  Synthetic polypeptide
  MISC_FEATURE (2)..(2): Each Xaa is independently selected from M, G, A, V, I and L.
  MISC_FEATURE (7)..(10): Each Xaa is independently selected from M, G, A, V, I and L.
  MISC_FEATURE (13)..(13): Each Xaa is independently selected from M, G, A, V, I and L.
TXSSSNXXXXYDXH

SEQ ID NO: 1002 - protein, 7 aa, Artificial Sequence
  Synthetic polypeptide
  MISC_FEATURE (1)..(1): Xaa may be M, G, A, V, I, or L
  MISC_FEATURE (3)..(3): Xaa may be A, C, D, E, F, I, K, L, M, N, P, Q, R, V, W, or Y
XNXHRPS

SEQ ID NO: 1003 - protein, 7 aa, Artificial Sequence
  Synthetic polypeptide
GQSHRPS

SEQ ID NO: 1004 - protein, 7 aa, Artificial Sequence
  Synthetic polypeptide
  MISC_FEATURE (1)..(1): Each Xaa is independently selected from M, G, A, V, I and L.
XQSHRPS

SEQ ID NO: 1005 - protein, 11 aa, Artificial Sequence
  Synthetic polypeptide
  MISC_FEATURE (5)..(5): Each Xaa is independently selected from M, G, A, V, I and L.
QSYDXSLSGYV

SEQ ID NO: 1006 - protein, 10 aa, Artificial Sequence
  Synthetic polypeptide
SYESSLSGYV

SEQ ID NO: 1007 - protein, 11 aa, Artificial Sequence
  Synthetic polypeptide
  MISC_FEATURE (7)..(7): Each Xaa is independently selected from M, G, A, V, I and L.
  MISC_FEATURE (9)..(9): Each Xaa is independently selected from M, G, A, V, I and L.
  MISC_FEATURE (11)..(11): Each Xaa is independently selected from M, G, A, V, I and L.
QSYDSSXSXYX

SEQ ID NO: 1008 - protein, 11 aa, Artificial Sequence
  Synthetic polypeptide
  MISC_FEATURE (5)..(5): Each Xaa is independently selected from M, G, A, V, I and L.
  MISC_FEATURE (7)..(7): Each Xaa is independently selected from M, G, A, V, I and L.
  MISC_FEATURE (9)..(9): Each Xaa is independently selected from M, G, A, V, I and L.
  MISC_FEATURE (11)..(11): Each Xaa is independently selected from M, G, A, V, I and L.
QSYDXSXSXYX

SEQ ID NO: 1009 - protein, 11 aa, Artificial Sequence
  Synthetic polypeptide
  MISC_FEATURE (7)..(7): Each Xaa is independently selected from M, G, A, V, I and L.
  MISC_FEATURE (9)..(9): Each Xaa is independently selected from M, G, A, V, I and L.
  MISC_FEATURE (11)..(11): Each Xaa is independently selected from M, G, A, V, I and L.
QSYESSXSXYX

SEQ ID NO: 1010 - protein, 5 aa, Artificial Sequence
  Synthetic polypeptide
  MISC_FEATURE (3)..(4): Each Xaa is independently selected from M, G, A, V, I and L.
NYXXS

SEQ ID NO: 1011 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXSXRXXSTYYXDSXKX

SEQ ID NO: 1012 - protein, 11 aa, Artificial Sequence
  Synthetic polypeptide
  MISC_FEATURE (2)..(2): Each Xaa is independently selected from M, G, A, V, I and L.
DXYSSAWYFDY

SEQ ID NO: 1013 - protein, 11 aa, Artificial Sequence
  Synthetic polypeptide
EGYSSAWYFDY

SEQ ID NO: 1014 - protein, 11 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
DXYSSXWYFDY

SEQ ID NO: 1015 - protein, 11 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
EXYSSXWYFDY

SEQ ID NO: 1016 - protein, 14 aa, Artificial Sequence
  Synthetic polypeptide
  MISC_FEATURE (2)..(2): Each Xaa is independently selected from M, G, A, V, I and L.
  MISC_FEATURE (4)..(4): Each Xaa is independently selected from M, G, A, V, I and L.
  MISC_FEATURE (7)..(10): Each Xaa is independently selected from M, G, A, V, I and L.
  MISC_FEATURE (13)..(13): Each Xaa is independently selected from M, G, A, V, I and L.
TXSXSNXXXXYDXH

SEQ ID NO: 1017 - protein, 5 aa, Artificial Sequence
  Synthetic polypeptide
  MISC_FEATURE (3)..(4): Each Xaa is independently selected from M, G, A, V, I and L.
NYXXN

SEQ ID NO: 1018 - protein, 11 aa, Artificial Sequence
  Synthetic polypeptide
  MISC_FEATURE (2)..(2): Each Xaa is independently selected from M, G, A, V, I and L.
DXYSSAWFFDY

SEQ ID NO: 1019 - protein, 11 aa, Artificial Sequence
  Synthetic polypeptide
EGYSSAWFFDY

SEQ ID NO: 1020 - protein, 11 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
DXYSSXWFFDY

SEQ ID NO: 1021 - protein, 11 aa, Artificial Sequence
  Synthetic polypeptide
  MISC_FEATURE (2)..(2): Each Xaa is independently selected from M, G, A, V, I and L.
  MISC_FEATURE (10)..(10): Each Xaa is independently selected from M, G, A, V, I and L.
RXSQSFSSYXN

SEQ ID NO: 1022 - protein, 7 aa, Artificial Sequence
  Synthetic polypeptide
  MISC_FEATURE (4)..(4): Each Xaa is independently selected from M, G, A, V, I and L.
SSSXTWN

SEQ ID NO: 1023 - protein, 18 aa, Artificial Sequence
  Synthetic polypeptide
  MISC_FEATURE (13)..(14): Each Xaa is independently selected from M, G, A, V, I and L.
  MISC_FEATURE (16)..(16): Each Xaa is independently selected from M, G, A, V, I and L.
RTYQRSKWNNDYXXSXKS

SEQ ID NO: 1024 - protein, 11 aa, Artificial Sequence
  Synthetic polypeptide
  MISC_FEATURE (2)..(5): Each Xaa is independently selected from M, G, A, V, I and L.
EXXXXPRWFDP

SEQ ID NO: 1025 - protein, 11 aa, Artificial Sequence
  Synthetic polypeptide
  MISC_FEATURE (2)..(2): Each Xaa is independently selected from M, G, A, V, I and L.
  MISC_FEATURE (5)..(5): Each Xaa is independently selected from M, G, A, V, I and L.
  misc_feature (6)..(6): Xaa can be any naturally occurring amino acid
  MISC_FEATURE (9)..(9): Each Xaa is independently selected from M, G, A, V, I and L.
  misc_feature (10)..(10): Xaa can be any naturally occurring amino acid
RXSQSXTSYXN

SEQ ID NO: 1026 - protein, 7 aa, Artificial Sequence
  Synthetic polypeptide
  MISC_FEATURE (2)..(2): Each Xaa is independently selected from M, G, A, V, I and L.
  MISC_FEATURE (5)..(5): Each Xaa is independently selected from M, G, A, V, I and L.
TXSSXQS

SEQ ID NO: 1027 - protein, 7 aa, Artificial Sequence
  Synthetic polypeptide
  MISC_FEATURE (4)..(4): Each Xaa is independently selected from M, G, A, V, I and L.
SNSXTWN

SEQ ID NO: 1028 - protein, 7 aa, Artificial Sequence
  Synthetic polypeptide
SQSATWN

SEQ ID NO: 1029 - protein, 7 aa, Artificial Sequence
  Synthetic polypeptide
  MISC_FEATURE (4)..(4): Each Xaa is independently selected from M, G, A, V, I and L.
SQSXTWN

SEQ ID NO: 1030 - protein, 18 aa, Artificial Sequence
  Synthetic polypeptide
  MISC_FEATURE (8)..(8): Each Xaa is independently selected from M, G, A, V, I and L.
  MISC_FEATURE (13)..(14): Each Xaa is independently selected from M, G, A, V, I and L.
  MISC_FEATURE (16)..(16): Each Xaa is independently selected from M, G, A, V, I and L.
RTYYRSKXYNDYXXSXKS

SEQ ID NO: 1031 - protein, 13 aa, Artificial Sequence
  Synthetic polypeptide
  MISC_FEATURE (5)..(5): Xaa may be A, C, D, E, F, I, K, L, M, N, P, Q, R, V, W, or Y
  MISC_FEATURE (7)..(8): Xaa may independently be M, G, A, V, I, or L
  MISC_FEATURE (11)..(12): Xaa may independently be M, G, A, V, I, or L
SESNXDXXTNXXN

SEQ ID NO: 1032 - protein, 13 aa, Artificial Sequence
  Synthetic polypeptide
SESQSDIGTNAVN

SEQ ID NO: 1033 - protein, 13 aa, Artificial Sequence
  Synthetic polypeptide
  MISC_FEATURE (7)..(8): Each Xaa is independently selected from M, G, A, V, I and L.
  MISC_FEATURE (11)..(12): Each Xaa is independently selected from M, G, A, V, I and L.
SESQSDXXTNXXN

SEQ ID NO: 1034 - protein, 11 aa, Artificial Sequence
  Synthetic polypeptide
  MISC_FEATURE (1)..(1): Each Xaa is independently selected from M, G, A, V, I and L.
  MISC_FEATURE (7)..(7): Each Xaa is independently selected from M, G, A, V, I and L.
  MISC_FEATURE (9)..(9): Each Xaa is independently selected from M, G, A, V, I and L.
  MISC_FEATURE (11)..(11): Each Xaa is independently selected from M, G, A, V, I and L.
XTWDDNXNXPX

SEQ ID NO: 1035 - protein, 11 aa, Artificial Sequence
  Synthetic polypeptide
ATWDDNLQGPL

SEQ ID NO: 1036 - protein, 11 aa, Artificial Sequence
  Synthetic polypeptide
  MISC_FEATURE (1)..(1): Each Xaa is independently selected from M, G, A, V, I and L.
  MISC_FEATURE (7)..(7): Each Xaa is independently selected from M, G, A, V, I and L.
  MISC_FEATURE (9)..(9): Each Xaa is independently selected from M, G, A, V, I and L.
  MISC_FEATURE (11)..(11): Each Xaa is independently selected from M, G, A, V, I and L.
XTWDDNXQXPX

SEQ ID NO: 1037 - protein, 5 aa, Artificial Sequence
  Synthetic polypeptide
  MISC_FEATURE (1)..(1): Each Xaa is independently selected from M, G, A, V, I and L.
  MISC_FEATURE (4)..(4): Each Xaa is independently selected from M, G, A, V, I and L.
XFYXH

SEQ ID NO: 1038 - protein, 17 aa, Artificial Sequence
  Synthetic polypeptide
  MISC_FEATURE (6)..(6): Each Xaa is independently selected from M, G, A, V, I and L.
WINPDXGGTNYAQKFQG

SEQ ID NO: 1039 - protein, 17 aa, Artificial Sequence
  Synthetic polypeptide
WINPESGGTNYAQKFQG

SEQ ID NO: 1040 - protein, 17 aa, Artificial Sequence
  Synthetic polypeptide
  MISC_FEATURE (2)..(2): Each Xaa is independently selected from M, G, A, V, I and L.
  MISC_FEATURE (7)..(8): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
WXNPDSXXTNYXQKFQX

SEQ ID NO: 1041 - protein, 17 aa, Artificial Sequence
  Synthetic polypeptide
  MISC_FEATURE (2)..(2): Each Xaa is independently selected from M, G, A, V, I and L.
  MISC_FEATURE (6)..(8): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
WXNPDXXXTNYXQKFQX

SEQ ID NO: 1042 - protein, 17 aa, Artificial Sequence
  Synthetic polypeptide
  MISC_FEATURE (2)..(2): Each Xaa is independently selected from M, G, A, V, I and L.
  MISC_FEATURE (7)..(8): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
WXNPESXXTNYXQKFQX

SEQ ID NO: 1043 - protein, 9 aa, Artificial Sequence
  Synthetic polypeptide
  MISC_FEATURE (2)..(7): Each Xaa is independently selected from M, G, A, V, I and L.
EXXXXXXTY

SEQ ID NO: 1044 - protein, 11 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
  MISC_FEATURE (10)..(10): Each Xaa is independently selected from M, G, A, V, I and L.
RXSQSXSSYXN

SEQ ID NO: 1045 - protein, 5 aa, Artificial Sequence
  Synthetic polypeptide
  MISC_FEATURE (1)..(1): Each Xaa is independently selected from M, G, A, V, I and L.
XYYWS

SEQ ID NO: 1046 - protein, 16 aa, Artificial Sequence
  Synthetic polypeptide
  MISC_FEATURE (2)..(2): Xaa may independently be M, G, A, V, I, or L
  MISC_FEATURE (4)..(4): A, C, D, E, F, I, K, L, M, N, P, Q, R, V, W, or Y
  MISC_FEATURE (6)..(6): Xaa may independently be M, G, A, V, I, or L
  MISC_FEATURE (14)..(14): Xaa may independently be M, G, A, V, I, or L
EXNXSXRTNYNPSXKS

SEQ ID NO: 1047 - protein, 16 aa, Artificial Sequence
  Synthetic polypeptide
EIQHSGRTNYNPSLKS

SEQ ID NO: 1048 - protein, 16 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
  MISC_FEATURE (14)..(14): Each Xaa is independently selected from M, G, A, V, I and L.
EXQHSXRTNYNPSXKS

SEQ ID NO: 1049 - protein, 10 aa, Artificial Sequence
  Synthetic polypeptide
  MISC_FEATURE (2)..(2): Each Xaa is independently selected from M, G, A, V, I and L.
DXGWHFSFDI

SEQ ID NO: 1050 - protein, 10 aa, Artificial Sequence
  Synthetic polypeptide
ESGWHFSFDI

SEQ ID NO: 1051 - protein, 10 aa, Artificial Sequence
  Synthetic polypeptide
  MISC_FEATURE (3)..(3): Each Xaa is independently selected from M, G, A, V, I and L.
  MISC_FEATURE (10)..(10): Each Xaa is independently selected from M, G, A, V, I and L.
DSXWHFSFDX

SEQ ID NO: 1052 - protein, 10 aa, Artificial Sequence
  Synthetic polypeptide
  MISC_FEATURE (3)..(3): Each Xaa is independently selected from M, G, A, V, I and L.
  MISC_FEATURE (10)..(10): Each Xaa is independently selected from M, G, A, V, I and L.
ESXWHFSFDX

SEQ ID NO: 1053 - protein, 11 aa, Artificial Sequence
  Synthetic polypeptide
  MISC_FEATURE (2)..(2): Each Xaa is independently selected from M, G, A, V, I and L.
  MISC_FEATURE (5)..(6): Each Xaa is independently selected from M, G, A, V, I and L.
  MISC_FEATURE (11)..(11): Each Xaa is independently selected from M, G, A, V, I and L.
RXSQXXRNDLX

SEQ ID NO: 1054 - protein, 7 aa, Artificial Sequence
  Synthetic polypeptide
  MISC_FEATURE (1)..(2): Each Xaa is independently selected from M, G, A, V, I and L.
  MISC_FEATURE (4)..(5): Each Xaa is independently selected from M, G, A, V, I and L.
  MISC_FEATURE (7)..(7): Each Xaa is independently selected from M, G, A, V, I and L.
XXSXXQX

SEQ ID NO: 1055 - protein, 10 aa, Artificial Sequence
  Synthetic polypeptide
  MISC_FEATURE (1)..(1): Each Xaa is independently selected from M, G, A, V, I and L.
XQHNSYPTWT

SEQ ID NO: 1056 - protein, 10 aa, Artificial Sequence
  Synthetic polypeptide
LQHQSYPTWT

SEQ ID NO: 1057 - protein, 10 aa, Artificial Sequence
  Synthetic polypeptide
  MISC_FEATURE (1)..(1): Each Xaa is independently selected from M, G, A, V, I and L.
XQHQSYPTWT

SEQ ID NO: 1058 - protein, 17 aa, Artificial Sequence
  Synthetic polypeptide
  MISC_FEATURE (6)..(6): Each Xaa is independently selected from M, G, A, V, I and L.
  MISC_FEATURE (14)..(14): Each Xaa is independently selected from M, G, A, V, I and L.
VIWFDXSNEYYADXVKG

SEQ ID NO: 1059 - protein, 17 aa, Artificial Sequence
  Synthetic polypeptide
VIWFEGSNEYYADSVKG

SEQ ID NO: 1060 - protein, 17 aa, Artificial Sequence
  Synthetic polypeptide
VIWFDGSNEYYAESVKG

SEQ ID NO: 1061 - protein, 17 aa, Artificial Sequence
  Synthetic polypeptide
VIWFEGSNEYYAESVKG

SEQ ID NO: 1062 - protein, 16 aa, Artificial Sequence
  Synthetic polypeptide
  MISC_FEATURE (1)..(1): Each Xaa is independently selected from M, G, A, V, I and L.
  MISC_FEATURE (5)..(5): Each Xaa is independently selected from M, G, A, V, I and L.
  MISC_FEATURE (11)..(11): Each Xaa is independently selected from M, G, A, V, I and L.
  MISC_FEATURE (14)..(14): Each Xaa is independently selected from M, G, A, V, I and L.
  MISC_FEATURE (16)..(16): Each Xaa is independently selected from M, G, A, V, I and L.
XWFDXSNEYYXDSXKX

SEQ ID NO: 1063 - protein, 10 aa, Artificial Sequence
  Synthetic polypeptide
  MISC_FEATURE (5)..(5): Each Xaa is independently selected from M, G, A, V, I and L.
  MISC_FEATURE (7)..(8): Each Xaa is independently selected from M, G, A, V, I and L.
ERWFXEXXDY

SEQ ID NO: 1064 - protein, 11 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
  MISC_FEATURE (10)..(10): Each Xaa is independently selected from M, G, A, V, I and L.
RXSQSXSYYXN

SEQ ID NO: 1065 - protein, 8 aa, Artificial Sequence
  Synthetic polypeptide
  MISC_FEATURE (7)..(7): Each Xaa is independently selected from M, G, A, V, I and L.
QQSYSSXT

SEQ ID NO: 1066 - protein, 17 aa, Artificial Sequence
  Synthetic polypeptide
  MISC_FEATURE (14)..(14): Each Xaa is independently selected from M, G, A, V, I and L.
GISGGGGSTYYADXVKG

SEQ ID NO: 1067 - protein, 17 aa, Artificial Sequence
  Synthetic polypeptide
GISGGGGSTYYAESVKG

SEQ ID NO: 1068 - protein, 17 aa, Artificial Sequence
  Synthetic polypeptide
  MISC_FEATURE (1)..(2): Each Xaa is independently selected from M, G, A, V, I and L.
  MISC_FEATURE (4)..(7): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXSXXXXSTYYXDSXKX

SEQ ID NO: 1069 - protein, 17 aa, Artificial Sequence
  Synthetic polypeptide
  MISC_FEATURE (1)..(2): Each Xaa is independently selected from M, G, A, V, I and L.
  MISC_FEATURE (4)..(7): Each Xaa is independently selected from M, G, A, V, I and L.
  MISC_FEATURE (12)..(12): Each Xaa is independently selected from M, G, A, V, I and L.
  MISC_FEATURE (14)..(15): Each Xaa is independently selected from M, G, A, V, I and L.
  MISC_FEATURE (17)..(17): Each Xaa is independently selected from M, G, A, V, I and L.
XXSXXXXSTYYXDXXKX

SEQ ID NO: 1070 - protein, 17 aa, Artificial Sequence
  Synthetic polypeptide
  MISC_FEATURE (1)..(2): Each Xaa is independently selected from M, G, A, V, I and L.
  MISC_FEATURE (4)..(7): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXSXXXXSTYYXESXKX

SEQ ID NO: 1071 - protein, 8 aa, Artificial Sequence
  Synthetic polypeptide
  MISC_FEATURE (2)..(5): Each Xaa is independently selected from M, G, A, V, I and L.
  MISC_FEATURE (8)..(8): Each Xaa is independently selected from M, G, A, V, I and L.
EXXXXFDX

SEQ ID NO: 1072 - protein, 11 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
  MISC_FEATURE (10)..(10): Each Xaa is independently selected from M, G, A, V, I and L.
RXSQNXSSYXN

SEQ ID NO: 1073 - protein, 7 aa, Artificial Sequence
  Synthetic polypeptide
  MISC_FEATURE (2)..(2): Each Xaa is independently selected from M, G, A, V, I and L.
  MISC_FEATURE (5)..(5): Each Xaa is independently selected from M, G, A, V, I and L.
TXSSXQS

SEQ ID NO: 1074 - protein, 16 aa, Artificial Sequence
  Synthetic polypeptide
  MISC_FEATURE (2)..(2): Each Xaa is independently selected from M, G, A, V, I and L.
  MISC_FEATURE (5)..(6): Each Xaa is independently selected from M, G, A, V, I and L.
  MISC_FEATURE (14)..(14): Each Xaa is independently selected from M, G, A, V, I and L.
EXNPXXRTNYKPSXKS

SEQ ID NO: 1075 - protein, 10 aa, Artificial Sequence
  Synthetic polypeptide
  MISC_FEATURE (3)..(3): Each Xaa is independently selected from M, G, A, V, I and L.
  MISC_FEATURE (7)..(7): Each Xaa is independently selected from M, G, A, V, I and L.
  MISC_FEATURE (10)..(10): Each Xaa is independently selected from M, G, A, V, I and L.
DNXWHYXFDX

SEQ ID NO: 1076 - protein, 10 aa, Artificial Sequence
  Synthetic polypeptide
DQGWHYAFDI

SEQ ID NO: 1077 - protein, 10 aa, Artificial Sequence
  Synthetic polypeptide
  MISC_FEATURE (3)..(3): Each Xaa is independently selected from M, G, A, V, I and L.
  MISC_FEATURE (7)..(7): Each Xaa is independently selected from M, G, A, V, I and L.
  MISC_FEATURE (10)..(10): Each Xaa is independently selected from M, G, A, V, I and L.
DQXWHYXFDX

SEQ ID NO: 1078 - protein, 16 aa, Artificial Sequence
  Synthetic polypeptide
  MISC_FEATURE (6)..(7): Each Xaa is independently selected from M, G, A, V, I and L.
  MISC_FEATURE (11)..(11): Each Xaa is independently selected from M, G, A, V, I and L.
  MISC_FEATURE (15)..(15): Each Xaa is independently selected from M, G, A, V, I and L.
RSSQSXXYSDXNTYXN

SEQ ID NO: 1079 - protein, 16 aa, Artificial Sequence
  Synthetic polypeptide
RSSQSLVYSDGQTYLN

SEQ ID NO: 1080 - protein, 16 aa, Artificial Sequence
  Synthetic polypeptide
  MISC_FEATURE (6)..(7): Each Xaa is independently selected from M, G, A, V, I and L.
  MISC_FEATURE (11)..(11): Each Xaa is independently selected from M, G, A, V, I and L.
  MISC_FEATURE (15)..(15): Each Xaa is independently selected from M, G, A, V, I and L.
RSSQSXXYSDXQTYXN

SEQ ID NO: 1081 - protein, 7 aa, Artificial Sequence
  Synthetic polypeptide
  MISC_FEATURE (7)..(7): Each Xaa is independently selected from M, G, A, V, I and L.
KVSNWDX

SEQ ID NO: 1082 - protein, 7 aa, Artificial Sequence
  Synthetic polypeptide
KVSNWES

SEQ ID NO: 1083 - protein, 7 aa, Artificial Sequence
  Synthetic polypeptide
  MISC_FEATURE (2)..(2): Each Xaa is independently selected from M, G, A, V, I and L.
KXSNWDS

SEQ ID NO: 1084 - protein, 7 aa, Artificial Sequence
  Synthetic polypeptide
  MISC_FEATURE (2)..(2): Each Xaa is independently selected from M, G, A, V, I and L.
  MISC_FEATURE (7)..(7): Each Xaa is independently selected from M, G, A, V, I and L.
KXSNWDX

SEQ ID NO: 1085 - protein, 7 aa, Artificial Sequence
  Synthetic polypeptide
  MISC_FEATURE (2)..(2): Each Xaa is independently selected from M, G, A, V, I and L.
KXSNWES

SEQ ID NO: 1086 - protein, 7 aa, Artificial Sequence
  Synthetic polypeptide
  MISC_FEATURE (1)..(1): Each Xaa is independently selected from M, G, A, V, I and L.
  MISC_FEATURE (3)..(3): Each Xaa is independently selected from M, G, A, V, I and L.
XQXTHWP

SEQ ID NO: 1087 - protein, 5 aa, Artificial Sequence
  Synthetic polypeptide
  MISC_FEATURE (1)..(1): Each Xaa is independently selected from M, G, A, V, I and L.
  MISC_FEATURE (4)..(4): Each Xaa is independently selected from M, G, A, V, I and L.
XYYXH

SEQ ID NO: 1088 - protein, 17 aa, Artificial Sequence
  Synthetic polypeptide
  MISC_FEATURE (2)..(2): Xaa may independently be M, G, A, V, I, or L
  MISC_FEATURE (6)..(6): Xaa may be A, C, D, E, F, I, K, L, M, N, P, Q, R, V, W, or Y
  MISC_FEATURE (7)..(8): Xaa may independently be M, G, A, V, I, or L
  MISC_FEATURE (12)..(12): Xaa may independently be M, G, A, V, I, or L
  MISC_FEATURE (17)..(17): Xaa may independently be M, G, A, V, I, or L
WXNPNXXXTNYXQKFRX

SEQ ID NO: 1089 - protein, 17 aa, Artificial Sequence
  Synthetic polypeptide
WINPQSGGTNYAQKFRG

SEQ ID NO: 1090 - protein, 17 aa, Artificial Sequence
  Synthetic polypeptide
  MISC_FEATURE (2)..(2): Each Xaa is independently selected from M, G, A, V, I and L.
  MISC_FEATURE (7)..(8): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
WXNPQSXXTNYXQKFRX

SEQ ID NO: 1091 - protein, 9 aa, Artificial Sequence
  Synthetic polypeptide
  MISC_FEATURE (1)..(2): Each Xaa is independently selected from M, G, A, V, I and L.
  MISC_FEATURE (6)..(6): Each Xaa is independently selected from M, G, A, V, I and L.
XXSWEXFDY

SEQ ID NO: 1092 - protein, 7 aa, Artificial Sequence
  Synthetic polypeptide
  MISC_FEATURE (1)..(2): Each Xaa is independently selected from M, G, A, V, I and L.
  MISC_FEATURE (5)..(5): Each Xaa is independently selected from M, G, A, V, I and L.
XXSRXQS

SEQ ID NO: 1093 - protein, 9 aa, Artificial Sequence
  Synthetic polypeptide
  MISC_FEATURE (8)..(8): Each Xaa is independently selected from M, G, A, V, I and L.
QQSDSTPXT

SEQ ID NO: 1094 - protein, 8 aa, Artificial Sequence
  Synthetic polypeptide
  MISC_FEATURE (7)..(7): Each Xaa is independently selected from M, G, A, V, I and L.
QQSFSTXT

SEQ ID NO: 1095 - protein, 17 aa, Artificial Sequence
  Synthetic polypeptide
  MISC_FEATURE (14)..(14): Each Xaa is independently selected from M, G, A, V, I and L.
GISGSGGSRYYADXVKG

SEQ ID NO: 1096 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (15)..(15): Each Xaa is independently selected from M, G, A, V, I and L.
  MISC_FEATURE (17)..(17): Each Xaa is independently selected from M, G, A, V, I and L.
XXSXSXXSRYYXDSXKX

SEQ ID NO: 1097 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (14)..(15): Each Xaa is independently selected from M, G, A, V, I and L.
  MISC_FEATURE (17)..(17): Each Xaa is independently selected from M, G, A, V, I and L.
XXSXSXXSRYYXDXXKX

SEQ ID NO: 1098 - protein, 7 aa, Artificial Sequence
  Synthetic polypeptide
  MISC_FEATURE (1)..(2): Each Xaa is independently selected from M, G, A, V, I and L.
  MISC_FEATURE (5)..(5): Each Xaa is independently selected from M, G, A, V, I and L.
XXSRXQS

SEQ ID NO: 1099 - protein, 9 aa, Artificial Sequence
  Synthetic polypeptide
  MISC_FEATURE (5)..(5): Each Xaa is independently selected from M, G, A, V, I and L.
QQSDXTPIT

SEQ ID NO: 1100 - protein, 9 aa, Artificial Sequence
  Synthetic polypeptide
  MISC_FEATURE (8)..(8): Each Xaa is independently selected from M, G, A, V, I and L.
QQSDTTPXT

SEQ ID NO: 1101 - protein, 9 aa, Artificial Sequence
  Synthetic polypeptide
  MISC_FEATURE (5)..(5): Each Xaa is independently selected from M, G, A, V, I and L.
  MISC_FEATURE (8)..(8): Each Xaa is independently selected from M, G, A, V, I and L.
QQSDXTPXT

SEQ ID NO: 1102 - protein, 17 aa, Artificial Sequence
  Synthetic polypeptide
  MISC_FEATURE (2)..(3): Each Xaa is independently selected from M, G, A, V, I and L.
  MISC_FEATURE (6)..(6): Xaa may be A, C, D, E, F, I, K, L, M, N, P, Q, R, V, W, or Y
  MISC_FEATURE (7)..(8): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
WXXPNXXXTNYXQKFQX

SEQ ID NO: 1103 - protein, 17 aa, Artificial Sequence
  Synthetic polypeptide
WIIPQSGGTNYAQKFQG

SEQ ID NO: 1104 - protein, 17 aa, Artificial Sequence
  Synthetic polypeptide
  MISC_FEATURE (2)..(3): Each Xaa is independently selected from M, G, A, V, I and L.
  MISC_FEATURE (7)..(8): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
WXXPQSXXTNYXQKFQX

SEQ ID NO: 1105 - protein, 9 aa, Artificial Sequence
  Synthetic polypeptide
  MISC_FEATURE (1)..(1): Each Xaa is independently selected from M, G, A, V, I and L.
  MISC_FEATURE (6)..(6): Each Xaa is independently selected from M, G, A, V, I and L.
XSSWEXFDY

SEQ ID NO: 1106 - protein, 11 aa, Artificial Sequence
  Synthetic polypeptide
  MISC_FEATURE (2)..(2): Each Xaa is independently selected from M, G, A, V, I and L.
  MISC_FEATURE (6)..(6): Each Xaa is independently selected from M, G, A, V, I and L.
  MISC_FEATURE (10)..(10): Each Xaa is independently selected from M, G, A, V, I and L.
RXSQSXSHYXN

SEQ ID NO: 1107 - protein, 8 aa, Artificial Sequence
  Synthetic polypeptide
  MISC_FEATURE (7)..(7): Each Xaa is independently selected from M, G, A, V, I and L.
QQSFSSXT

SEQ ID NO: 1108 - protein, 17 aa, Artificial Sequence
  Synthetic polypeptide
  MISC_FEATURE (14)..(14): Each Xaa is independently selected from M, G, A, V, I and L.
GISGRGGSTYYADXVKG

SEQ ID NO: 1109 - protein, 17 aa, Artificial Sequence
  Synthetic polypeptide
GISGRGGSTYYAESVKG

SEQ ID NO: 1110 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
XXSXRXXSTYYXDSVKX

SEQ ID NO: 1111 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (14)..(14): Each Xaa is independently selected from M, G, A, V, I and L.
  MISC_FEATURE (17)..(17): Each Xaa is independently selected from M, G, A, V, I and L.
XXSXRXXSTYYXDXVKX

SEQ ID NO: 1112 - protein, 17 aa, Artificial Sequence
  Synthetic polypeptide
  MISC_FEATURE (1)..(2): Each Xaa is independently selected from M, G, A, V, I and L.
  MISC_FEATURE (4)..(4): Each Xaa is independently selected from M, G, A, V, I and L.
  MISC_FEATURE (6)..(7): Each Xaa is independently selected from M, G, A, V, I and L.
  MISC_FEATURE (12)..(12): Each Xaa is independently selected from M, G, A, V, I and L.
  MISC_FEATURE (17)..(17): Each Xaa is independently selected from M, G, A, V, I and L.
XXSXRXXSTYYXESVKX

SEQ ID NO: 1113 - protein, 16 aa, Artificial Sequence
  Synthetic polypeptide
RSSQSLLHSNGYNYLD

SEQ ID NO: 1114 - protein, 17 aa, Artificial Sequence
  Synthetic polypeptide
AISGSGGSTYYADSVKG

SEQ ID NO: 1115 - DNA, 645 bp, Homo sapiens
gacatccagatgacccagtctccatcctccctgtctgcatctgtaggagacagagtcaccatcacttgccgggcaagtcagggcattagaaatgacttaggctggtatcaggagaaaccagggaaagcccctaagcgcctgatctatgctgcatccggtttacaaggtggggacccatcaaggttcagcggcagtggatctgggacagaattcactctcacaatcagcagcctgcagcctgaagattttgcaacttattactgtctacagcataatagttaccccacgtggacgttcggccaagggaccaaggtggaaatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1116 - protein, 215 aa, Homo sapiens
DIQMTQSPSSLSASVGDRVTITCRASQGIRNDLGWYQEKPGKAPKRLIYAASGLQGGDPSRFSGSGSGTEFTLTISSLQPEDFATYYCLQHNSYPTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1117 - DNA, 1335 bp, Homo sapiens
caggtgcagctggtggagtccggggcaggcgtggtccagcctgggaggtccctgagactctcctgtgcagcgtctggattcaccttcagtagctatggcatgcactgggtccgccaggctccaggcatggggctggagtgggtggcagttatatggtttgatggaagtaatgaatactatgcagactccgtgaagggccgattcaccatctccagagacaattccaagaacacgctgtatctgcaaatgaacagcctgagagccgaggacacggctgtgtattactgtgcgagagagcgatggttcggggagttattagactactggggccagggaaccctggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1118 - protein, 445 aa, Homo sapiens
QVQLVESGAGVVQPGRSLRLSCAASGFTFSSYGMHWVRQAPGMGLEWVAVIWFDGSNEYYADSVKGRFTISRDNSKNTLYLQMNSLRAEDTAVYYCARERWFGELLDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1119 - DNA, 660 bp, Homo sapiens
gacatcgtgatgacccagtctccagactccctggctgtgtctctgggcgagagggccaccatcaactgcaagtccagtcagaatattttatacagctccaacaataaaaactacttagcttggtaccagcagaaaccaggacagcctcctagcctgctcatttactgggcatctacccgggaatccggggtccctgaccgattcagtggcagcgggtctgggacagatttcactctcaccctcagcagcctgcaggctgaagatgtggcagtttatttctgtcaacaatattatagtattccgtggacgttcggccaagggaccaaggtggaaatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1120 - protein, 220 aa, Homo sapiens
DIVMTQSPDSLAVSLGERATINCKSSQNILYSSNNKNYLAWYQQKPGQPPSLLIYWASTRESGVPDRFSGSGSGTDFTLTLSSLQAEDVAVYFCQQYYSIPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1121 - DNA, 1344 bp, Homo sapiens
caggtgcagttggtggagtctgggggaggcgtggtccagcctgggaggtccctgagactctcctgtgcagcgtctggattcaccttcagtacttatggcatgcactgggtccgccaggctccaggcaaggggctggagtgggtggcagttatttggtatgatggaagtaataaagactatgcagactccgtgaagggccgattcaccgtctccagagacaattccagggacacgttgtatctgcaaatgaacagcctgagagccgaggacacggctgtgtattactgtgcgagagaggaaagggattcgtactaccattacgggatggacgtctggggccaagggaccacggtcaccgtctcttcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1122 - protein, 448 aa, Homo sapiens
QVQLVESGGGVVQPGRSLRLSCAASGFTFSTYGMHWVRQAPGKGLEWVAVIWYDGSNKDYADSVKGRFTVSRDNSRDTLYLQMNSLRAEDTAVYYCAREERDSYYHYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1123 - DNA, 651 bp, Homo sapiens
cagtctgtgctgacgcagccgccctcagtgtctggggccccagggcagagggtcaccatctcctgcactgggagcggctccaacatcggggcaggttatgatgtacactggtaccagcagcttccaggaacagcccccaaactcctcatctatggtaatagtcatcggccctcagggatccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggtcagcccaaggctgccccctcggtcactctgttcccgccctctagcgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 1124 - protein, 217 aa, Homo sapiens
QSVLTQPPSVSGAPGQRVTISCTGSGSNIGAGYDVHWYQQLPGTAPKLLIYGNSHRPSGIPDRFSGSKSGTSASLAITGLQAEDEADYYCQSYDSSLSGYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1125 - DNA, 1338 bp, Homo sapiens
gaggtgcagctgttggaatctgggggaggcttggtacagccgggggggtccctgagactctcctgtgcagcctctggattcacctttagcaactatgccatgaactgggtccgccaggctccagggaaggggctggagtgggtctcagtcattagtggtcgtggtggtagtacatactatgcagactccgtgaagggccggttcaccatctccagagacaattccaggaacacgctgtatctgcaaatgaacagcctgagagccgaggacacggccatatattactgtgcgaaagacgggtatagcagtgcctggttctttgactactggggccagggaaccctgatcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1126 - protein, 446 aa, Homo sapiens
EVQLLESGGGLVQPGGSLRLSCAASGFTFSNYAMNWVRQAPGKGLEWVSVISGRGGSTYYADSVKGRFTISRDNSRNTLYLQMNSLRAEDTAIYYCAKDGYSSAWFFDYWGQGTLITVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1127 - DNA, 657 bp, Homo sapiens
gatattgtgatgactcagtctccactctccctgcccgtcacccctggagagccggcctccatctcctgcaggtctagtcagagcctcctgtatagtaatggatacaactatttggattggtacctgcagaagccagggcagtctccacagctcctgatctatttgggttctagtcgggcctccggggtccctgacaggttcagtggcagtggatcaggcacagattttacactgaaaatcagcagagtggaggctgaggatgttggggtttattactgcatgcaacctctacaaactccgctcactttcggcggagggaccaaggtggagatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1128 - protein, 219 aa, Homo sapiens
DIVMTQSPLSLPVTPGEPASISCRSSQSLLYSNGYNYLDWYLQKPGQSPQLLIYLGSSRASGVPDRFSGSGSGTDFTLKISRVEAEDVGVYYCMQPLQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1129 - DNA, 1353 bp, Homo sapiens
gaggtgcagctggtggagtctgggggaggcctggtcaagcctggggggtccctgagactctcctgtgcagcctctgaattcaccttcagtacctattacatgagctgggtccgccaggctccagggaaggggctggagtgggtctcatccattagtagtagtagtagtttcatatactacgcagactcagtgaagggccgattcaccatctccagagacaacgccaagaactcactgtatctgcaaatgaacagcctgagagccgaggacacggctgtatattactgtgcgagagaccgtatagcagcacctggtacatactactactacggtatggacgtctggggccaagggaccacggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1130 - protein, 451 aa, Homo sapiens
EVQLVESGGGLVKPGGSLRLSCAASEFTFSTYYMSWVRQAPGKGLEWVSSISSSSSFIYYADSVKGRFTISRDNAKNSLYLQMNSLRAEDTAVYYCARDRIAAPGTYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1131 - DNA, 639 bp, Homo sapiens
gacatccagatgatccagtctccatcctccctgtctgcatctgtaggagacagcgtcaccatcacttgccgggcaagtcagagcattagttactatttaaattggtatcaacagaaaccagggaaagcccctaagttcctgatctatgctgcatccagtttacaaagtggggtcccatcaaggtttagtggcagtggatctgggacagatttcactctcaccatcagcagtctgcaacctgaagattttgcaacttactactgtcaacagagttacagttccatcaccttcggccaagggacacgactggagattaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1132 - protein, 213 aa, Homo sapiens
DIQMIQSPSSLSASVGDSVTITCRASQSISYYLNWYQQKPGKAPKFLIYAASSLQSGVPSRFSGSGSGTDFTLTISSLQPEDFATYYCQQSYSSITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1133 - DNA, 1329 bp, Homo sapiens
gaggtgcacctgttggagtctgggggaggcttggtacagcctggggggtccctgagactctcctgtgcagcctctggattcacctttagcagctatgccatgagctgggtccgccaggctccagggaaggggctggagtgggtctcaggtattagtggtggtggtggtagcacatactacgcagactccgtgaagggccggttcaccatctccagagacaattccaagaacacgctgtatctgcaaatgaacagcctgagagccgagaacacggccgtatattactgtgcgatagaaatggctggggcttttgatatctggggccaagggacaatggtcaccgtctcttcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1134 - protein, 443 aa, Homo sapiens
EVHLLESGGGLVQPGGSLRLSCAASGFTFSSYAMSWVRQAPGKGLEWVSGISGGGGSTYYADSVKGRFTISRDNSKNTLYLQMNSLRAENTAVYYCAIEMAGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1135 - DNA, 648 bp, Homo sapiens
gacatccagatgacccagtctccatcctccctgtctgcatctgtaggagacagagtcaccatcacttgccgggcaagtcagaacattagcagctatttaaattggtatcagcagagaccagggaaagcccctaacctcctgctctttactgcatccagtttgcaaagtggggtcccatcaaggttcagtggcagtggatctgggacagatttcactctcaccatcaacagtctgcaacctgaggattttgcaacttactactgtcaacagagttacagtaaccctcctgagagcagttttggccaggggaccaagctggagatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1136 - protein, 216 aa, Homo sapiens
DIQMTQSPSSLSASVGDRVTITCRASQNISSYLNWYQQRPGKAPNLLLFTASSLQSGVPSRFSGSGSGTDFTLTINSLQPEDFATYYCQQSYSNPPESSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1137 - DNA, 1332 bp, Homo sapiens
caggtgcagctacagcagtggggcgcaggactgttgaagccttcggagaccctgtccctcacctgcgctgtctatggtgggtccttcagtgggtactactggagctggatccgccagcctccagggaaggggctggagtggattggggaaatcaatcctgttggaagaaccaactacaaaccgtccctcaagagtcgagtcaccatatcagtagacacgtccaagaaccagttctccctgaagctgagttctgtgaccgccgcggacacggctctgtattactgtgcgagggacaatgggtggcactatgcttttgatatctggggccaagggacaatggtcaccgtctcttcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1138 - protein, 444 aa, Homo sapiens
QVQLQQWGAGLLKPSETLSLTCAVYGGSFSGYYWSWIRQPPGKGLEWIGEINPVGRTNYKPSLKSRVTISVDTSKNQFSLKLSSVTAADTALYYCARDNGWHYAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1139 - DNA, 651 bp, Homo sapiens
cagtctgtgctgacgcagccgccctcagtgtctggggccccagggcagagggtcaccatctcctgcactgggagcagctccaacatcggggcaggttataatgttcactggtaccagcagcttccaggaacagcccccaaactcctcatctatggtaacaacaatcggccctcaggggtccctgaccgattctctggctccaagtctggcacctcagcctccctggccatcactggactccagactgaggatgaggctgattattactgccagtcctatgacagcagcctgagtggttgggtgttcggcggagggaccaagctgaccgtcctaggtcagcccaaggctgccccctcggtcactctgttcccgccctctagcgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 1140 - protein, 217 aa, Homo sapiens
QSVLTQPPSVSGAPGQRVTISCTGSSSNIGAGYNVHWYQQLPGTAPKLLIYGNNNRPSGVPDRFSGSKSGTSASLAITGLQTEDEADYYCQSYDSSLSGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1141 - DNA, 1347 bp, Homo sapiens
gaaatacagctgttggagtctgggggaggcttggtacagcctggggggtccctgagactttcctgtgtagcctctggattcacctttagcagctatgtcatgagctgggtccgccaggctccagggaaggggctggagtgggtctcagttattagtggtagtggtggtagcacatactacgcagactccgtgaagggccggttcaccatctccagagacaattccaagaccacgctgtatctgcaaatgaacagcctgagagccgaggacacggccgtatattactgtgcgaaaggtggtaccaactattactactactactccggtatggacgtctggggccaagggaccacggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1142 - protein, 449 aa, Homo sapiens
EIQLLESGGGLVQPGGSLRLSCVASGFTFSSYVMSWVRQAPGKGLEWVSVISGSGGSTYYADSVKGRFTISRDNSKTTLYLQMNSLRAEDTAVYYCAKGGTNYYYYYSGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1143 - DNA, 639 bp, Homo sapiens
gacatccagatgatccagtctccatcctccctgtctgcatctgtaggagacagagtcaccatcacttgccgggcaagtcagagcattagcagctatttaaattggtatcaacagaaaccagggaaagcccctaaattcctgatctatgctgcatccagtttacaaagtggggtcccttcaaggtttagtggcagtgggtctgggacagatttcactctcaccatcagcagtctgcaacctgaagattttgcaacttactactgtcaacagagtttcagtaccatcaccttcggccaagggacacgactggagattaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1144 - protein, 213 aa, Homo sapiens
DIQMIQSPSSLSASVGDRVTITCRASQSISSYLNWYQQKPGKAPKFLIYAASSLQSGVPSRFSGSGSGTDFTLTISSLQPEDFATYYCQQSFSTITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1145 - DNA, 1329 bp, Homo sapiens
gaggtgcagctgttggagtctgggggaggcttggtacagcctggggggtccctgagactctcctgtgtagcctctggattcacctttagtagctatgccatgagctgggtccgccaggctccagggaaggggctggagtgggtctcaggtattagtggtagtggtggtagcagatactacgcagactccgtgaagggccggttcaccatctccagagacaattccaagaacacgctgtatctgcaaatgaacagcctgagagccgaggacacggccgtatattactgtgcgatagaagtggctggggcttttgatatctggggccaagggacaatggtcaccgtctcttcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1146 - protein, 443 aa, Homo sapiens
EVQLLESGGGLVQPGGSLRLSCVASGFTFSSYAMSWVRQAPGKGLEWVSGISGSGGSRYYADSVKGRFTISRDNSKNTLYLQMNSLRAEDTAVYYCAIEVAGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1147 - DNA, 642 bp, Homo sapiens
gacatccagatgacccagtctccatcctccctgtctgcatctgtaggagacagagtcaccatcacttgccgggcaagtcagagcgttaccagctatttaaattggtatcagcagaaaccagggaaagcccctaaactcctgatctatactgcatccagtttgcaaagtgggatcccatcaaggttcagtggcagtggatctgggacagatttcactctcaccatcagcagtctgcaacctgaagattttgcaacttacttctgtcaacagagttacagtacccctcgcagttttggccaggggaccaagctggagatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1148 - protein, 214 aa, Homo sapiens
DIQMTQSPSSLSASVGDRVTITCRASQSVTSYLNWYQQKPGKAPKLLIYTASSLQSGIPSRFSGSGSGTDFTLTISSLQPEDFATYFCQQSYSTPRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1149 - DNA, 1347 bp, Homo sapiens
caggtacagctgcagcagtcaggtccaggactggtgaagccctcgcagaccctctcactcacctgtgccatctccggggacagtgtctctagcaacagtgctacttggaactggatcaggcagtccccatcgagaggccttgagtggctgggaaggacatactacaggtccaagttgtataatgattatgcagtatctgtgaaaagtcgaataaccatcaacccagacacatccaagaaccagttctccctgcagctgaactctgtgactcccgaggacacggctgtgtattactgtgcaagagaagtagtggctggcccgaggtggttcgacccctggggccagggaaccctggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1150 - protein, 449 aa, Homo sapiens
QVQLQQSGPGLVKPSQTLSLTCAISGDSVSSNSATWNWIRQSPSRGLEWLGRTYYRSKLYNDYAVSVKSRITINPDTSKNQFSLQLNSVTPEDTAVYYCAREVVAGPRWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1151 - DNA, 648 bp, Homo sapiens
gacatccagatgacccagtctccatcctccctgtctgcatctgtaggagacagagtcaccatcacttgccgggcaagtcagagcattagcagttatttaaattggtatcagcagaaaccagggaaagcccctaagctcctgatctatgttgcatccagtttgcaaagtggggtcccatcaaggttcagtggcagtggatctgggacagatttcactctcaccatcagcagtctgcaacctgaagattttgcaacttactactgtcaacagagttacagtaatcctcaggagtgcagttttggccaggggaccaagctggagatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1152 - protein, 216 aa, Homo sapiens
DIQMTQSPSSLSASVGDRVTITCRASQSISSYLNWYQQKPGKAPKLLIYVASSLQSGVPSRFSGSGSGTDFTLTISSLQPEDFATYYCQQSYSNPQECSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1153 - DNA, 1332 bp, Homo sapiens
caggagcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagaaccaactacaacccgtccctcaagagtcgagtcaccatatcagtggacacgtccaagaaccagttctccctgaagctgagctctgtgaccgccgcggacacggctgtgtattactgtgcgagggacagtggctggcacttttcttttgatatctgggaccaagggacaatggtcaccgtctcttcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1154 - protein, 444 aa, Homo sapiens
QEQLQQWGAGLLKPSETLSLTCAVYGGSFSGYYWSWIRQPPGKGLEWIGEINHSGRTNYNPSLKSRVTISVDTSKNQFSLKLSSVTAADTAVYYCARDSGWHFSFDIWDQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1155 - DNA, 651 bp, Homo sapiens
cagtctgtgctgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagccatcggccctcaggggtccctgaccgattctctggctccaagtctggcacctcagcctccctggccatcactgggctccaggctgaggatgaggctgattattactgccagtcctatgacagcagcctgagtggttatgtcttcggaactgggaccaaggtcaccgtcctaggtcagcccaaggctgccccctcggtcactctgttcccgccctctagcgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 1156 - protein, 217 aa, Homo sapiens
QSVLTQPPSVSGAPGQRVTISCTGSSSNIGAGYDVHWYQQLPGTAPKLLIYGNSHRPSGVPDRFSGSKSGTSASLAITGLQAEDEADYYCQSYDSSLSGYVFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1157 - DNA, 1338 bp, Homo sapiens
gaggtgcagctgttggagtctgggggaggcttggtacagcctggggggtccctaagactctcctgtgcagcctctggattcacctttagcaactatgccatgagctgggtccgccaggctccagggaaggggctgcagtgggtctcagttattagtggtagaggtggtagcacatactacgcagactccgtgaagggccggttcaccatctccagagacaactccaagaacacgctgtatctgcaaatgaacagcctgagagccgaggacacggccgtatattactgtgcgaaagacgggtatagcagtgcctggtactttgactactggggccagggaaccctggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1158 - protein, 446 aa, Homo sapiens
EVQLLESGGGLVQPGGSLRLSCAASGFTFSNYAMSWVRQAPGKGLQWVSVISGRGGSTYYADSVKGRFTISRDNSKNTLYLQMNSLRAEDTAVYYCAKDGYSSAWYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1159 - DNA, 651 bp, Homo sapiens; identical to SEQ ID NO: 1139

SEQ ID NO: 1160 - protein, 217 aa, Homo sapiens; identical to SEQ ID NO: 1140

SEQ ID NO: 1161 - DNA, 1347 bp, Homo sapiens; identical to SEQ ID NO: 1141

SEQ ID NO: 1162 - protein, 449 aa, Homo sapiens; identical to SEQ ID NO: 1142

SEQ ID NO: 1163 - DNA, 642 bp, Homo sapiens
gacatccagatgacccagtctccatcctccctgtctgcatctgtaggagacagagtcaccatcacttgccgggcaagtcagagctttagcagttatttaaattggtatcagcagaaaccagggaaagcccctgagctcctgatctatgctgcatccagtttgcaaagtggggtcccatcaaggttcagtggcagtggatctgggacagatttcactctcaccatcagcagtctgcaacctgaagattttgcaagttacttctgtcaacagagttacagtacccctcgcagttttggccaggggaccaagctggagatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1164 - protein, 214 aa, Homo sapiens
DIQMTQSPSSLSASVGDRVTITCRASQSFSSYLNWYQQKPGKAPELLIYAASSLQSGVPSRFSGSGSGTDFTLTISSLQPEDFASYFCQQSYSTPRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1165 - DNA, 1347 bp, Homo sapiens
caggtacaactgcagcagtcaggtccaggactggtgaagccctcgcagaccctctcactcacctgtgccatctccggggacagtgtctctagcagcagtgctacttggaactggatcaggcagtccccatcgagaggccttgagtggctgggaaggacataccagaggtccaagtggaataatgattatgcagtatctgtgaaaagtcgaataaccatcaacccagacacatccaggaaccagttctccctgcagctgaactctgtgactcccgaggacacggctgtgtattactgtgcaagagaagtagtggctggcccgaggtggttcgacccctggggccagggaaccctggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1166 - protein, 449 aa, Homo sapiens
QVQLQQSGPGLVKPSQTLSLTCAISGDSVSSSSATWNWIRQSPSRGLEWLGRTYQRSKWNNDYAVSVKSRITINPDTSRNQFSLQLNSVTPEDTAVYYCAREVVAGPRWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1167 - DNA, 648 bp, Homo sapiens
cagtctgtgctgactcaaccaccctcagcgtctgggacccccgggcagagggtcaccatctcttgttctgaaagcaactccgacatcggaactaatgctgtaaactggtaccagcagttcccaggaacggcccccaaattcctcatctatagtaataataagcggccctcaggagtccctgaccgattctctggctccaagtctggcacctcagcctccctggccatcagtgggctccagtctgaggatgaggctgattattactgtgcaacatgggatgacaacctcaatggtccgctattcggcggagggaccaagctgaccgtcctaggtcagcccaaggctgccccctcggtcactctgttcccgccctctagcgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 1168 - protein, 216 aa, Homo sapiens
QSVLTQPPSASGTPGQRVTISCSESNSDIGTNAVNWYQQFPGTAPKFLIYSNNKRPSGVPDRFSGSKSGTSASLAISGLQSEDEADYYCATWDDNLNGPLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1169 - DNA, 1332 bp, Homo sapiens
caggtgcaactggtgcagtctggggctgaggtgaagaagcctggggcctcagtgagggtctcctgcaaggcttctggatacaccttcaccggcttctatatgcactgggtgcgacaggcccctggacaagggcttgagtggatgggatggatcaaccctgacagtggtggcacaaactatgcacagaagtttcagggcagggtcaccatgaccagggacacgtccatcagcacagcctacatggagttgagtaggctgagatctgacgacacggccgtatattactgtgcgagagagggtatagcagtggctcttacctactggggccagggaaccctggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1170 - protein, 444 aa, Homo sapiens
QVQLVQSGAEVKKPGASVRVSCKASGYTFTGFYMHWVRQAPGQGLEWMGWINPDSGGTNYAQKFQGRVTMTRDTSISTAYMELSRLRSDDTAVYYCAREGIAVALTYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1171 - DNA, 660 bp, Homo sapiens
gacatcgtgatgacccagtctccagactccctgactgtgtctctgggcgagggggccaccatcaactgcaagtccagccagagtgttttatacagctccaacaataaaaactacttagcttggtaccagcagaaaccaggacagcctcctagcctgctcatttactgggcatctacccgggaatccggggtccctgaccgattcagtggcagcgggtctgggacagatttcactctcaccatcagcagcctgcaggctgaagatgtggcagtttattactgtcaacaatattatagtattccgtggacgttcggccaagggaccaaggtggaaatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1172 - protein, 220 aa, Homo sapiens
DIVMTQSPDSLTVSLGEGATINCKSSQSVLYSSNNKNYLAWYQQKPGQPPSLLIYWASTRESGVPDRFSGSGSGTDFTLTISSLQAEDVAVYYCQQYYSIPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1173 - DNA, 1344 bp, Homo sapiens
caggtgcagttggtggagtctgggggaggcgtggtccagcctgggaggtccctgagactctcctgtgcagcgtctggattcatcttcagtagttatggcatgcactgggtccgccaggctccaggcaaggggctggagtgggtggcagttatttggtatgatggaagtaataaagactatgcagactccgtgaagggccgattcaccgtctccagagacaattccagggacacgttgtatctgcaaatgaacagcctgagagccgaggacacggctgtgtattactgtgcgagagaggaaagggattcctactaccactacggtatggacgtctggggccaagggaccacggtcaccgtctcttcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1174 - protein, 448 aa, Homo sapiens
QVQLVESGGGVVQPGRSLRLSCAASGFIFSSYGMHWVRQAPGKGLEWVAVIWYDGSNKDYADSVKGRFTVSRDNSRDTLYLQMNSLRAEDTAVYYCAREERDSYYHYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1175 - DNA, 639 bp, Homo sapiens
gacatccagatgatccagtctccatcctccctgtctgcatctgtaggagacagagtcaccatcacttgccgggcaagtcagagcattagccactatttaaattggtatcagcagaaaccagggaaagcccctaagttcctgatctatgctgcatccagtttacaaagtggggtcccatcaaggtttagtggcagtggatctgggacagatttcactctcaccatcagcagtctgcaacctgaagattttgcaacttactactgtcaacagagtttcagtagcatcaccttcggccaagggacacgactggagattaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1176 - protein, 213 aa, Homo sapiens
DIQMIQSPSSLSASVGDRVTITCRASQSISHYLNWYQQKPGKAPKFLIYAASSLQSGVPSRFSGSGSGTDFTLTISSLQPEDFATYYCQQSFSSITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1177 - DNA, 1329 bp, Homo sapiens
gaggtgcacctgttggagtctgggggaggcttggtacagccgggggggtccctgagactctcttgtgcagcctctggattcacctttagcagttatgccatgagttgggtccgccaggttccagggaaggggctggagtgggtctcaggtattagtggtagaggtggtagcacatactacgcagactccgtgaagggccggttcaccatctccagagacaattccaagaacacgctgtatctgcaaatggacagcctgagagccgaggacacggccgtatataactgtgcgatagaagtggctggggcttttgatatctggggccaagggacaatggtcaccgtctcttcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1178 - protein, 443 aa, Homo sapiens
EVHLLESGGGLVQPGGSLRLSCAASGFTFSSYAMSWVRQVPGKGLEWVSGISGRGGSTYYADSVKGRFTISRDNSKNTLYLQMDSLRAEDTAVYNCAIEVAGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1179 - DNA, 642 bp, Homo sapiens
gacatccagatgacccagtctccatcctccctgtctgcatctgtaggagacagagtcaccatcacttgccgggcaagtcagagcattagcagctatttaaattggtatcagcagaaaccagggacagcccctaagttcctgatctatggtgcatcccgtttgcaaagtggggtcccatcaaggttcagtggcagtggatctgggacagatttcactctcaccatcagcagtctgcaacctgaagactttgcaacttactactgtcaacagagtgacactaccccgatcaccttcggccaagggacacgactggagattaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1180 - protein, 214 aa, Homo sapiens
DIQMTQSPSSLSASVGDRVTITCRASQSISSYLNWYQQKPGTAPKFLIYGASRLQSGVPSRFSGSGSGTDFTLTISSLQPEDFATYYCQQSDTTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1181 - DNA, 1332 bp, Homo sapiens
caggtgcagctggtgcaatctggggctgaggtgaagaagcctggggcctcagtgcaggtctcctgcaaggcttctggatacaccttcaccggctactatatgcactggattcgacaggcccctgggcaagggcttgagtggctgggatggatcatccctaacagtggtggcacaaattatgcccagaagtttcagggcagggtcaccatgaccagggacacgtccatcagcacagcctacatggaactgagcaggctgagatctgacgacacggccgtttattactgtgcgactggcagcagctgggagggatttgactactggggccagggaaccctggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1182 - protein, 444 aa, Homo sapiens
QVQLVQSGAEVKKPGASVQVSCKASGYTFTGYYMHWIRQAPGQGLEWLGWIIPNSGGTNYAQKFQGRVTMTRDTSISTAYMELSRLRSDDTAVYYCATGSSWEGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1183 - DNA, 651 bp, Homo sapiens
gatgttgtgatgactcagtctccactctccctgcccgtcacccttggacagccggcctccatctcctgcaggtctagtcaaagcctcgtatacagtgacggaaacacctacttgaattggtttcagcagaggccaggccgatctccaaggcgcttaatttataaggtttctaactgggactctggggtcccagacagattcagcggcagtgggtcaggcactgattccacactgataatcagcagggtggaggctgaggatgttggggtttattactacatgcaaggtacacactggcctctcggcggagggaccaaggtggagatcaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1184 - protein, 217 aa, Homo sapiens
DVVMTQSPLSLPVTLGQPASISCRSSQSLVYSDGNTYLNWFQQRPGRSPRRLIYKVSNWDSGVPDRFSGSGSGTDSTLIISRVEAEDVGVYYYMQGTHWPLGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1185 - DNA, 1332 bp, Homo sapiens
cagggacagctggtgcagtctggggctgaggtgaagaagcctggggcctcagtgaaggtctcctgccaggcttctggatacaccttcaccgcctactatatgcactgggtgcgacaggcccctggacaagggcttgagtggatgggttggatcaaccctaacagtggtggcacaaactatgcacagaagtttcggggcagggtcaccatgaccagggacacgtccatcagcacagcctacatggaactgagcaggctgagatctgacgacacggccgtgtattactgtgcgactggcggcagctgggagggttttgactactggggccagggaaccctggtcaccgtctcctcagcctccaccaagggcccatcggtcttccccctggcgccctgctctagaagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacatgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 1186 - protein, 444 aa, Homo sapiens
QGQLVQSGAEVKKPGASVKVSCQASGYTFTAYYMHWVRQAPGQGLEWMGWINPNSGGTNYAQKFRGRVTMTRDTSISTAYMELSRLRSDDTAVYYCATGGSWEGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1187 - DNA, 642 bp, Homo sapiens
gacatccagatgacccagtctccatcgtccctgtctgcatctgtaggagacagagtcaccatcacttgccgggcaagtcagagcattagcagctatttaaattggtatcagcagaaaccagggaaagcccctaagttcctgatctatgctgcatccaggttgcaaagtggggtcccatcaaggttcagtggcagtggatctgggacagatttcactctcaccatcagtagtctgcaacctgaagattttgcaacttactactgtcaacagagtgacagtaccccgatcaccttcggccaagggacacgactggagattaaacgaactgtggctgcaccatctgtcttcatcttcccgccatctgatgagcagttgaaatctggaactgctagcgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 1188 - protein, 214 aa, Homo sapiens
DIQMTQSPSSLSASVGDRVTITCRASQSISSYLNWYQQKPGKAPKFLIYAASRLQSGVPSRFSGSGSGTDFTLTISSLQPEDFATYYCQQSDSTPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1189 - DNA, 33 bp, Artificial Sequence; identical to SEQ ID NO: 149
  Synthetic oligonucleotide

SEQ ID NO: 1190 - protein, 444 aa, Homo sapiens; identical to SEQ ID NO: 1186

SEQ ID NO: 1191 - DNA, 25 bp, Artificial Sequence
  Synthetic polynucleotide
caccatggactggacctggaggatc

SEQ ID NO: 1192 - DNA, 25 bp, Artificial Sequence
  Synthetic polynucleotide
caccatggactggacctggagcatc

SEQ ID NO: 1193 - DNA, 25 bp, Artificial Sequence
  Synthetic polynucleotide
caccatggactgcacctggaggatc

SEQ ID NO: 1194 - DNA, 25 bp, Artificial Sequence
  Synthetic polynucleotide
caccatggactggacctggagaatc

SEQ ID NO: 1195 - DNA, 23 bp, Artificial Sequence
  Synthetic polynucleotide
caccatggactggacctggaggg

SEQ ID NO: 1196 - DNA, 26 bp, Artificial Sequence
  Synthetic polynucleotide
caccatggactggatttggaggatcc

SEQ ID NO: 1197 - DNA, 25 bp, Artificial Sequence
  Synthetic polynucleotide
caccatggacacactttgctccacg

SEQ ID NO: 1198 - DNA, 29 bp, Artificial Sequence
  Synthetic polynucleotide
caccatggacacactttgctacacactcc

SEQ ID NO: 1199 - DNA, 24 bp, Artificial Sequence
  Synthetic polynucleotide
caccatggagtttgggctgagctg

SEQ ID NO: 1200 - DNA, 24 bp, Artificial Sequence
  Synthetic polynucleotide
caccatggaattggggctgagctg

SEQ ID NO: 1201 - DNA, 24 bp, Artificial Sequence
  Synthetic polynucleotide
caccatggagttggggctgagctg

SEQ ID NO: 1202 - DNA, 22 bp, Artificial Sequence
  Synthetic polynucleotide
caccatggaactggggctccgc

SEQ ID NO: 1203 - DNA, 25 bp, Artificial Sequence
  Synthetic polynucleotide
caccatggaatttgggctgagctgg

SEQ ID NO: 1204 - DNA, 24 bp, Artificial Sequence
  Synthetic polynucleotide
caccatggagttggggctgtgctg

SEQ ID NO: 1205 - DNA, 25 bp, Artificial Sequence
  Synthetic polynucleotide
caccatggagtttgggcttagctgg

SEQ ID NO: 1206 - DNA, 25 bp, Artificial Sequence
  Synthetic polynucleotide
caccatggagttttggctgagctgg

SEQ ID NO: 1207 - DNA, 28 bp, Artificial Sequence
  Synthetic polynucleotide
caccatgaaacacctgtggttcttcctc

SEQ ID NO: 1208 - DNA, 26 bp, Artificial Sequence
  Synthetic polynucleotide
caccatgaagcacctgtggttcttcc

SEQ ID NO: 1209 - DNA, 31 bp, Artificial Sequence
  Synthetic polynucleotide
caccatgaaacatctgtggttcttccttctc

SEQ ID NO: 1210 - DNA, 23 bp, Artificial Sequence
  Synthetic polynucleotide
caccatggggtcaaccgccatcc

SEQ ID NO: 1211 - DNA, 28 bp, Artificial Sequence
  Synthetic polynucleotide
caccatgtctgtctccttcctcatcttc

SEQ ID NO: 1212 - DNA, 28 bp, Artificial Sequence
  Synthetic polynucleotide
gctgagggagtagagtcctgaggactgt

SEQ ID NO: 1213 - DNA, 23 bp, Artificial Sequence
  Synthetic polynucleotide
caccatggacatgagggtccccg

SEQ ID NO: 1214 - DNA, 24 bp, Artificial Sequence
  Synthetic polynucleotide
caccatggacatgagggtccctgc

SEQ ID NO: 1215 - DNA, 24 bp, Artificial Sequence
  Synthetic polynucleotide
caccatggacatgagggtcctcgc

SEQ ID NO: 1216 - DNA, 23 bp, Artificial Sequence
  Synthetic polynucleotide
caccatgaggctccctgctcagc

SEQ ID NO: 1217 - DNA, 26 bp, Artificial Sequence
  Synthetic polynucleotide
caccatgaggctccttgctcagcttc

SEQ ID NO: 1218 - DNA, 23 bp, Artificial Sequence
  Synthetic polynucleotide
caccatggaaaccccagcgcagc

SEQ ID NO: 1219 - DNA, 22 bp, Artificial Sequence
  Synthetic polynucleotide
caccatggaagccccagcgcag

SEQ ID NO: 1220 - DNA, 22 bp, Artificial Sequence
  Synthetic polynucleotide
caccatggaagccccagctcag

SEQ ID NO: 1221 - DNA, 25 bp, Artificial Sequence
  Synthetic polynucleotide
caccatggaaccatggaagccccag

SEQ ID NO: 1222 - DNA, 25 bp, Artificial Sequence
  Synthetic polynucleotide
caccatggtgttgcagacccaggtc

SEQ ID NO: 1223 - DNA, 23 bp, Artificial Sequence
  Synthetic polynucleotide
caccatggggtcccaggttcacc

SEQ ID NO: 1224 - DNA, 28 bp, Artificial Sequence
  Synthetic polynucleotide
caccatgttgccatcacaactcattggg

SEQ ID NO: 1225 - DNA, 25 bp, Artificial Sequence
  Synthetic polynucleotide
caccatggtgtccccgttgcaattc

SEQ ID NO: 1226 - DNA, 25 bp, Artificial Sequence
  Synthetic polynucleotide
acccgattggagggcgttatccacc

SEQ ID NO: 1227 - DNA, 22 bp, Artificial Sequence
  Synthetic polynucleotide
caccatggcctggtcccctctc

SEQ ID NO: 1228 - DNA, 23 bp, Artificial Sequence
  Synthetic polynucleotide
caccatggcctggtctcctctcc

SEQ ID NO: 1229 - DNA, 23 bp, Artificial Sequence
  Synthetic polynucleotide
caccatggccagcttccctctcc

SEQ ID NO: 1230 - DNA, 22 bp, Artificial Sequence
  Synthetic polynucleotide
caccatggccggcttccctctc

SEQ ID NO: 1231 - DNA, 23 bp, Artificial Sequence
  Synthetic polynucleotide
caccatgacctgctcccctctcc

SEQ ID NO: 1232 - DNA, 22 bp, Artificial Sequence
  Synthetic polynucleotide
caccatggcctgggctctgctc

SEQ ID NO: 1233 - DNA, 22 bp, Artificial Sequence
  Synthetic polynucleotide
caccatggcctgggctctgctg

SEQ ID NO: 1234 - DNA, 25 bp, Artificial Sequence
  Synthetic polynucleotide
caccatggcatggatccctctcttc

SEQ ID NO: 1235 - DNA, 22 bp, Artificial Sequence
  Synthetic polynucleotide
caccatggcctggaccgctctc

SEQ ID NO: 1236 - DNA, 22 bp, Artificial Sequence
  Synthetic polynucleotide
caccatggcctggacccctctc

SEQ ID NO: 1237 - DNA, 23 bp, Artificial Sequence
  Synthetic polynucleotide
caccatggcctggatccctctcc

SEQ ID NO: 1238 - DNA, 23 bp, Artificial Sequence
  Synthetic polynucleotide
caccatggcctggaccgttctcc

SEQ ID NO: 1239 - DNA, 23 bp, Artificial Sequence
  Synthetic polynucleotide
caccatggcatgggccacactcc

SEQ ID NO: 1240 - DNA, 23 bp, Artificial Sequence
  Synthetic polynucleotide
caccatggcctggatccctctac

SEQ ID NO: 1241 - DNA, 25 bp, Artificial Sequence
  Synthetic polynucleotide
caccatggcctgggtctccttctac

SEQ ID NO: 1242 - DNA, 23 bp, Artificial Sequence
  Synthetic polynucleotide
caccatggcctggacccaactcc

SEQ ID NO: 1243 - DNA, 23 bp, Artificial Sequence
  Synthetic polynucleotide
caccatggcttggaccccactcc

SEQ ID NO: 1244 - DNA, 23 bp, Artificial Sequence
  Synthetic polynucleotide
caccatggcctggactcctctcc

SEQ ID NO: 1245 - DNA, 26 bp, Artificial Sequence
  Synthetic polynucleotide
caccatggcctggactcctcttcttc

SEQ ID NO: 1246 - DNA, 26 bp, Artificial Sequence
  Synthetic polynucleotide
caccatggcctggactcttctccttc

SEQ ID NO: 1247 - DNA, 23 bp, Artificial Sequence
  Synthetic polynucleotide
caccatggcctgggctccactac

SEQ ID NO: 1248 - DNA, 26 bp, Artificial Sequence
  Synthetic polynucleotide
caccatggcctggactcctctctttc

SEQ ID NO: 1249 - DNA, 26 bp, Artificial Sequence
  Synthetic polynucleotide
caccatggcctggatgatgcttctcc

SEQ ID NO: 1250 - DNA, 22 bp, Artificial Sequence
  Synthetic polynucleotide
caccatggcctgggctcctctg

SEQ ID NO: 1251 - DNA, 22 bp, Artificial Sequence
  Synthetic polynucleotide
caccatgccctgggctctgctc

SEQ ID NO: 1252 - DNA, 25 bp, Artificial Sequence
  Synthetic polynucleotide
  misc_feature (8)..(8): K is G or T.
ggagggtktggtggtctccactccc

SEQ ID NO: 1253 - DNA, 642 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1254 - protein, 214 aa, Artificial Sequence
  Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1255 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1256 - protein, 214 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1257 - DNA, 2046 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1258 - protein, 682 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1259 - DNA, 642 bp, Artificial Sequence; identical to SEQ ID NO: 1253
  Synthetic polynucleotide

SEQ ID NO: 1260 - protein, 214 aa, Artificial Sequence; identical to SEQ ID NO: 1254
  Synthetic polypeptide

SEQ ID NO: 1261 - DNA, 642 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1262 - protein, 214 aa, Artificial Sequence
  Synthetic polypeptide
DIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1263 - DNA, 2040 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1264 - protein, 680 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1265 - DNA, 642 bp, Artificial Sequence; identical to SEQ ID NO: 1253
  Synthetic polynucleotide

SEQ ID NO: 1266 - protein, 214 aa, Artificial Sequence; identical to SEQ ID NO: 1254
  Synthetic polypeptide

SEQ ID NO: 1267 - DNA, 660 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1268 - protein, 220 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1269 - DNA, 2061 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1270 - protein, 687 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1271 - DNA, 651 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccgagagctatctgagcctgacgcctgagcagtggaagtcccacagaagctacagctgccaggtcacgcatgaagggagcaccgtggagaagacagtggcccctacagaatgttca

SEQ ID NO: 1272 - protein, 217 aa, Artificial Sequence
  Synthetic polypeptide
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 1273 - DNA, 642 bp, Artificial Sequence; identical to SEQ ID NO: 1255
  Synthetic polynucleotide

SEQ ID NO: 1274 - protein, 214 aa, Artificial Sequence; identical to SEQ ID NO: 1256
  Synthetic polypeptide

SEQ ID NO: 1275 - DNA, 2031 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1276 - protein, 677 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1277 - DNA, 651 bp, Artificial Sequence; identical to SEQ ID NO: 1271
  Synthetic polynucleotide

SEQ ID NO: 1278 - protein, 217 aa, Artificial Sequence; identical to SEQ ID NO: 1272
  Synthetic polypeptide

SEQ ID NO: 1279 - DNA, 642 bp, Artificial Sequence; identical to SEQ ID NO: 1261
  Synthetic polynucleotide

SEQ ID NO: 1280 - protein, 214 aa, Artificial Sequence; identical to SEQ ID NO: 1262
  Synthetic polypeptide

SEQ ID NO: 1281 - DNA, 2025 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1282 - protein, 675 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1283 - DNA, 651 bp, Artificial Sequence; identical to SEQ ID NO: 1271
  Synthetic polynucleotide

SEQ ID NO: 1284 - protein, 217 aa, Artificial Sequence; identical to SEQ ID NO: 1272
  Synthetic polypeptide

SEQ ID NO: 1285 - DNA, 660 bp, Artificial Sequence; identical to SEQ ID NO: 1267
  Synthetic polynucleotide

SEQ ID NO: 1286 - protein, 220 aa, Artificial Sequence; identical to SEQ ID NO: 1268
  Synthetic polypeptide

SEQ ID NO: 1287 - DNA, 2046 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1288 - protein, 682 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1289 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1290 - protein, 214 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1291 - DNA, 642 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1292 - protein, 214 aa, Artificial Sequence
  Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1293 - DNA, 2046 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1294 - protein, 682 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1295 - DNA, 642 bp, Artificial Sequence; identical to SEQ ID NO: 1289
  Synthetic polynucleotide

SEQ ID NO: 1296 - protein, 214 aa, Artificial Sequence; identical to SEQ ID NO: 1290
  Synthetic polypeptide

SEQ ID NO: 1297 - DNA, 651 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 1298 - protein, 217 aa, Artificial Sequence
  Synthetic polypeptide
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 1299 - DNA, 2031 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1300 - protein, 677 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1301 - DNA, 642 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1302 - protein, 214 aa, Artificial Sequence
  Synthetic polypeptide
DIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1303 - DNA, 642 bp, Artificial Sequence; identical to SEQ ID NO: 1291
  Synthetic polynucleotide

SEQ ID NO: 1304 - protein, 214 aa, Artificial Sequence; identical to SEQ ID NO: 1292
  Synthetic polypeptide

SEQ ID NO: 1305 - DNA, 2040 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1306 - protein, 680 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1307 - DNA, 642 bp, Artificial Sequence; identical to SEQ ID NO: 1301
  Synthetic polynucleotide

SEQ ID NO: 1308 - protein, 214 aa, Artificial Sequence; identical to SEQ ID NO: 1302
  Synthetic polypeptide

SEQ ID NO: 1309 - DNA, 651 bp, Artificial Sequence; identical to SEQ ID NO: 1297
  Synthetic polynucleotide

SEQ ID NO: 1310 - protein, 217 aa, Artificial Sequence; identical to SEQ ID NO: 1298
  Synthetic polypeptide

SEQ ID NO: 1311 - DNA, 2025 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1312 - protein, 675 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1313 - DNA, 660 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1314 - protein, 220 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1315 - DNA, 642 bp, Artificial Sequence; identical to SEQ ID NO: 1291
  Synthetic polynucleotide

SEQ ID NO: 1316 - protein, 214 aa, Artificial Sequence; identical to SEQ ID NO: 1292
  Synthetic polypeptide

SEQ ID NO: 1317 - DNA, 2061 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1318 - protein, 687 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1319 - DNA, 660 bp, Artificial Sequence; identical to SEQ ID NO: 1313
  Synthetic polynucleotide

SEQ ID NO: 1320 - protein, 220 aa, Artificial Sequence; identical to SEQ ID NO: 1314
  Synthetic polypeptide

SEQ ID NO: 1321 - DNA, 651 bp, Artificial Sequence; identical to SEQ ID NO: 1297
  Synthetic polynucleotide

SEQ ID NO: 1322 - protein, 217 aa, Artificial Sequence; identical to SEQ ID NO: 1298
  Synthetic polypeptide

SEQ ID NO: 1323 - DNA, 2046 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1324 - protein, 682 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1325 - DNA, 642 bp, Artificial Sequence; identical to SEQ ID NO: 1255
  Synthetic polynucleotide

SEQ ID NO: 1326 - protein, 214 aa, Artificial Sequence; identical to SEQ ID NO: 1256
  Synthetic polypeptide

SEQ ID NO: 1327 - DNA, 2055 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1328 - protein, 685 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1329 - DNA, 633 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1330 - protein, 211 aa, Artificial Sequence
  Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1331 - DNA, 642 bp, Artificial Sequence; identical to SEQ ID NO: 1261
  Synthetic polynucleotide

SEQ ID NO: 1332 - protein, 214 aa, Artificial Sequence; identical to SEQ ID NO: 1262
  Synthetic polypeptide

SEQ ID NO: 1333 - DNA, 2049 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1334 - protein, 683 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1335 - DNA, 633 bp, Artificial Sequence; identical to SEQ ID NO: 1329
  Synthetic polynucleotide

SEQ ID NO: 1336 - protein, 211 aa, Artificial Sequence; identical to SEQ ID NO: 1330
  Synthetic polypeptide

SEQ ID NO: 1337 - DNA, 660 bp, Artificial Sequence; identical to SEQ ID NO: 1267
  Synthetic polynucleotide

SEQ ID NO: 1338 - protein, 220 aa, Artificial Sequence; identical to SEQ ID NO: 1268
  Synthetic polypeptide

SEQ ID NO: 1339 - DNA, 2070 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1340 - protein, 690 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1341 - DNA, 633 bp, Artificial Sequence; identical to SEQ ID NO: 1329
  Synthetic polynucleotide

SEQ ID NO: 1342 - protein, 211 aa, Artificial Sequence; identical to SEQ ID NO: 1330
  Synthetic polypeptide

SEQ ID NO: 1343 - DNA, 642 bp, Artificial Sequence; identical to SEQ ID NO: 1255
  Synthetic polynucleotide

SEQ ID NO: 1344 - protein, 214 aa, Artificial Sequence; identical to SEQ ID NO: 1256
  Synthetic polypeptide

SEQ ID NO: 1345 - DNA, 2037 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1346 - protein, 679 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1347 - DNA, 645 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1348 - protein, 215 aa, Artificial Sequence
  Synthetic polypeptide
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLGASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1349 - DNA, 642 bp, Artificial Sequence; identical to SEQ ID NO: 1261
  Synthetic polynucleotide

SEQ ID NO: 1350 - protein, 214 aa, Artificial Sequence; identical to SEQ ID NO: 1262
  Synthetic polypeptide

SEQ ID NO: 1351 - DNA, 2031 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1352 - protein, 677 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1353 - DNA, 645 bp, Artificial Sequence; identical to SEQ ID NO: 1347
  Synthetic polynucleotide

SEQ ID NO: 1354 - protein, 215 aa, Artificial Sequence; identical to SEQ ID NO: 1348
  Synthetic polypeptide

SEQ ID NO: 1355 - DNA, 660 bp, Artificial Sequence; identical to SEQ ID NO: 1267
  Synthetic polynucleotide

SEQ ID NO: 1356 - protein, 220 aa, Artificial Sequence; identical to SEQ ID NO: 1268
  Synthetic polypeptide

SEQ ID NO: 1357 - DNA, 2052 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1358 - protein, 684 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1359 - DNA, 645 bp, Artificial Sequence; identical to SEQ ID NO: 1347
  Synthetic polynucleotide

SEQ ID NO: 1360 - protein, 215 aa, Artificial Sequence; identical to SEQ ID NO: 1348
  Synthetic polypeptide

SEQ ID NO: 1361 - DNA, 642 bp, Artificial Sequence; identical to SEQ ID NO: 1291
  Synthetic polynucleotide

SEQ ID NO: 1362 - protein, 214 aa, Artificial Sequence; identical to SEQ ID NO: 1292
  Synthetic polypeptide

SEQ ID NO: 1363 - DNA, 2055 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1364 - protein, 685 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1365 - DNA, 633 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1366 - protein, 211 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1367 - DNA, 651 bp, Artificial Sequence; identical to SEQ ID NO: 1297
  Synthetic polynucleotide

SEQ ID NO: 1368 - protein, 217 aa, Artificial Sequence; identical to SEQ ID NO: 1298
  Synthetic polypeptide

SEQ ID NO: 1369 - DNA, 2040 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1370 - protein, 680 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1371 - DNA, 633 bp, Artificial Sequence; identical to SEQ ID NO: 1365
  Synthetic polynucleotide

SEQ ID NO: 1372 - protein, 211 aa, Artificial Sequence; identical to SEQ ID NO: 1366
  Synthetic polypeptide

SEQ ID NO: 1373 - DNA, 642 bp, Artificial Sequence; identical to SEQ ID NO: 1291
  Synthetic polynucleotide

SEQ ID NO: 1374 - protein, 214 aa, Artificial Sequence; identical to SEQ ID NO: 1292
  Synthetic polypeptide

SEQ ID NO: 1375 - DNA, 2049 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1376 - protein, 683 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1377 - DNA, 633 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1378 - protein, 211 aa, Artificial Sequence
  Synthetic polypeptide
DIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1379 - DNA, 651 bp, Artificial Sequence; identical to SEQ ID NO: 1297
  Synthetic polynucleotide

SEQ ID NO: 1380 - protein, 217 aa, Artificial Sequence; identical to SEQ ID NO: 1298
  Synthetic polypeptide

SEQ ID NO: 1381 - DNA, 2034 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1382 - protein, 678 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1383 - DNA, 633 bp, Artificial Sequence; identical to SEQ ID NO: 1377
  Synthetic polynucleotide

SEQ ID NO: 1384 - protein, 211 aa, Artificial Sequence; identical to SEQ ID NO: 1378
  Synthetic polypeptide

SEQ ID NO: 1385 - DNA, 642 bp, Artificial Sequence; identical to SEQ ID NO: 1291
  Synthetic polynucleotide

SEQ ID NO: 1386 - protein, 214 aa, Artificial Sequence; identical to SEQ ID NO: 1292
  Synthetic polypeptide

SEQ ID NO: 1387 - DNA, 2070 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1388 - protein, 690 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1389 - DNA, 651 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1390 - protein, 217 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1391 - DNA, 651 bp, Artificial Sequence; identical to SEQ ID NO: 1297
  Synthetic polynucleotide

SEQ ID NO: 1392 - protein, 217 aa, Artificial Sequence; identical to SEQ ID NO: 1298
  Synthetic polypeptide

SEQ ID NO: 1393 - DNA, 2055 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1394 - protein, 685 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1395 - DNA, 651 bp, Artificial Sequence; identical to SEQ ID NO: 1389
  Synthetic polynucleotide

SEQ ID NO: 1396 - protein, 217 aa, Artificial Sequence; identical to SEQ ID NO: 1390
  Synthetic polypeptide

SEQ ID NO: 1397 - DNA, 642 bp, Artificial Sequence; identical to SEQ ID NO: 1253
  Synthetic polynucleotide

SEQ ID NO: 1398 - protein, 214 aa, Artificial Sequence; identical to SEQ ID NO: 1254
  Synthetic polypeptide

SEQ ID NO: 1399 - DNA, 2055 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1400 - protein, 685 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1401 - DNA, 633 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1402 - protein, 211 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGQGTRLEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1403 - DNA, 642 bp, Artificial Sequence; identical to SEQ ID NO: 1253
  Synthetic polynucleotide

SEQ ID NO: 1404 - protein, 214 aa, Artificial Sequence; identical to SEQ ID NO: 1254
  Synthetic polypeptide

SEQ ID NO: 1405 - DNA, 2049 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1406 - protein, 683 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1407 - DNA, 633 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1408 - protein, 211 aa, Artificial Sequence
  Synthetic polypeptide
DIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGQGTKLEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1409 - DNA, 642 bp, Artificial Sequence; identical to SEQ ID NO: 1253
  Synthetic polynucleotide

SEQ ID NO: 1410 - protein, 214 aa, Artificial Sequence; identical to SEQ ID NO: 1254
  Synthetic polypeptide

SEQ ID NO: 1411 - DNA, 2070 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1412 - protein, 690 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1413 - DNA, 651 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1414 - protein, 217 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGGGTKVEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1415 - DNA, 651 bp, Artificial Sequence; identical to SEQ ID NO: 1271
  Synthetic polynucleotide

SEQ ID NO: 1416 - protein, 217 aa, Artificial Sequence; identical to SEQ ID NO: 1272
  Synthetic polypeptide

SEQ ID NO: 1417 - DNA, 2040 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1418 - protein, 680 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1419 - DNA, 633 bp, Artificial Sequence; identical to SEQ ID NO: 1401
  Synthetic polynucleotide

SEQ ID NO: 1420 - protein, 211 aa, Artificial Sequence; identical to SEQ ID NO: 1402
  Synthetic polypeptide

SEQ ID NO: 1421 - DNA, 651 bp, Artificial Sequence; identical to SEQ ID NO: 1271
  Synthetic polynucleotide

SEQ ID NO: 1422 - protein, 217 aa, Artificial Sequence; identical to SEQ ID NO: 1272
  Synthetic polypeptide

SEQ ID NO: 1423 - DNA, 2034 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1424 - protein, 678 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1425 - DNA, 633 bp, Artificial Sequence; identical to SEQ ID NO: 1407
  Synthetic polynucleotide

SEQ ID NO: 1426 - protein, 211 aa, Artificial Sequence; identical to SEQ ID NO: 1408
  Synthetic polypeptide

SEQ ID NO: 1427 - DNA, 651 bp, Artificial Sequence; identical to SEQ ID NO: 1271
  Synthetic polynucleotide

SEQ ID NO: 1428 - protein, 217 aa, Artificial Sequence; identical to SEQ ID NO: 1272
  Synthetic polypeptide

SEQ ID NO: 1429 - DNA, 2055 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1430 - protein, 685 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1431 - DNA, 651 bp, Artificial Sequence; identical to SEQ ID NO: 1413
  Synthetic polynucleotide

SEQ ID NO: 1432 - protein, 217 aa, Artificial Sequence; identical to SEQ ID NO: 1414
  Synthetic polypeptide

SEQ ID NO: 1433 - DNA, 642 bp, Artificial Sequence; identical to SEQ ID NO: 1289
  Synthetic polynucleotide

SEQ ID NO: 1434 - protein, 214 aa, Artificial Sequence; identical to SEQ ID NO: 1290
  Synthetic polypeptide

SEQ ID NO: 1435 - DNA, 2055 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1436 - protein, 685 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1437 - DNA, 633 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1438 - protein, 211 aa, Artificial Sequence
  Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1439 - DNA, 642 bp, Artificial Sequence; identical to SEQ ID NO: 1289
  Synthetic polynucleotide

SEQ ID NO: 1440 - protein, 214 aa, Artificial Sequence; identical to SEQ ID NO: 1290
  Synthetic polypeptide

SEQ ID NO: 1441 - DNA, 2037 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1442 - protein, 679 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1443 - DNA, 645 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1444 - protein, 215 aa, Artificial Sequence
  Synthetic polypeptide
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGGGTKLTVLGASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1445 - DNA, 642 bp, Artificial Sequence; identical to SEQ ID NO: 1301
  Synthetic polynucleotide

SEQ ID NO: 1446 - protein, 214 aa, Artificial Sequence; identical to SEQ ID NO: 1302
  Synthetic polypeptide

SEQ ID NO: 1447 - DNA, 2049 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1448 - protein, 683 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1449 - DNA, 633 bp, Artificial Sequence; identical to SEQ ID NO: 1437
  Synthetic polynucleotide

SEQ ID NO: 1450 - protein, 211 aa, Artificial Sequence; identical to SEQ ID NO: 1438
  Synthetic polypeptide

SEQ ID NO: 1451 - DNA, 642 bp, Artificial Sequence; identical to SEQ ID NO: 1301
  Synthetic polynucleotide

SEQ ID NO: 1452 - protein, 214 aa, Artificial Sequence; identical to SEQ ID NO: 1302
  Synthetic polypeptide

SEQ ID NO: 1453 - DNA, 2031 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1454 - protein, 677 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1455 - DNA, 645 bp, Artificial Sequence; identical to SEQ ID NO: 1443
  Synthetic polynucleotide

SEQ ID NO: 1456 - protein, 215 aa, Artificial Sequence; identical to SEQ ID NO: 1444
  Synthetic polypeptide

SEQ ID NO: 1457 - DNA, 660 bp, Artificial Sequence; identical to SEQ ID NO: 1313
  Synthetic polynucleotide

SEQ ID NO: 1458 - protein, 220 aa, Artificial Sequence; identical to SEQ ID NO: 1314
  Synthetic polypeptide

SEQ ID NO: 1459 - DNA, 2070 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1460 - protein, 690 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1461 - DNA, 633 bp, Artificial Sequence; identical to SEQ ID NO: 1437
  Synthetic polynucleotide

SEQ ID NO: 1462 - protein, 211 aa, Artificial Sequence; identical to SEQ ID NO: 1438
  Synthetic polypeptide

SEQ ID NO: 1463 - DNA, 660 bp, Artificial Sequence; identical to SEQ ID NO: 1313
  Synthetic polynucleotide

SEQ ID NO: 1464 - protein, 220 aa, Artificial Sequence; identical to SEQ ID NO: 1314
  Synthetic polypeptide

SEQ ID NO: 1465 - DNA, 2052 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1466 - protein, 684 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1467 - DNA, 645 bp, Artificial Sequence; identical to SEQ ID NO: 1443
  Synthetic polynucleotide

SEQ ID NO: 1468 - protein, 215 aa, Artificial Sequence; identical to SEQ ID NO: 1444
  Synthetic polypeptide

SEQ ID NO: 1469 - DNA, 2064 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1470 - protein, 688 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1471 - DNA, 633 bp, Artificial Sequence; identical to SEQ ID NO: 1401
  Synthetic polynucleotide

SEQ ID NO: 1472 - protein, 211 aa, Artificial Sequence; identical to SEQ ID NO: 1402
  Synthetic polypeptide

SEQ ID NO: 1473 - DNA, 633 bp, Artificial Sequence; identical to SEQ ID NO: 1329
  Synthetic polynucleotide

SEQ ID NO: 1474 - protein, 211 aa, Artificial Sequence; identical to SEQ ID NO: 1330
  Synthetic polypeptide

SEQ ID NO: 1475 - DNA, 2058 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1476 - protein, 686 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1477 - DNA, 633 bp, Artificial Sequence; identical to SEQ ID NO: 1407
  Synthetic polynucleotide

SEQ ID NO: 1478 - protein, 211 aa, Artificial Sequence; identical to SEQ ID NO: 1408
  Synthetic polypeptide

SEQ ID NO: 1479 - DNA, 633 bp, Artificial Sequence; identical to SEQ ID NO: 1329
  Synthetic polynucleotide

SEQ ID NO: 1480 - protein, 211 aa, Artificial Sequence; identical to SEQ ID NO: 1330
  Synthetic polypeptide

SEQ ID NO: 1481 - DNA, 2079 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1482 - protein, 693 aa, Artificial Sequence
  Synthetic polypeptide
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1483 - DNA, 651 bp, Artificial Sequence; identical to SEQ ID NO: 1413
  Synthetic polynucleotide

SEQ ID NO: 1484 - protein, 217 aa, Artificial Sequence; identical to SEQ ID NO: 1414
  Synthetic polypeptide

SEQ ID NO: 1485 - DNA, 633 bp, Artificial Sequence; identical to SEQ ID NO: 1329
  Synthetic polynucleotide

SEQ ID NO: 1486 - protein, 211 aa, Artificial Sequence; identical to SEQ ID NO: 1330
  Synthetic polypeptide

SEQ ID NO: 1487 - DNA, 2046 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1488 - protein, 682 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1489 - DNA, 633 bp, Artificial Sequence; identical to SEQ ID NO: 1401
  Synthetic polynucleotide

SEQ ID NO: 1490 - protein, 211 aa, Artificial Sequence; identical to SEQ ID NO: 1402
  Synthetic polypeptide

SEQ ID NO: 1491 - DNA, 645 bp, Artificial Sequence; identical to SEQ ID NO: 1347
  Synthetic polynucleotide

SEQ ID NO: 1492 - protein, 215 aa, Artificial Sequence; identical to SEQ ID NO: 1348
  Synthetic polypeptide

SEQ ID NO: 1493 - DNA, 2040 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1494 - protein, 680 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1495 - DNA, 633 bp, Artificial Sequence; identical to SEQ ID NO: 1407
  Synthetic polynucleotide

SEQ ID NO: 1496 - protein, 211 aa, Artificial Sequence; identical to SEQ ID NO: 1408
  Synthetic polypeptide

SEQ ID NO: 1497 - DNA, 645 bp, Artificial Sequence; identical to SEQ ID NO: 1347
  Synthetic polynucleotide

SEQ ID NO: 1498 - protein, 215 aa, Artificial Sequence; identical to SEQ ID NO: 1348
  Synthetic polypeptide

SEQ ID NO: 1499 - DNA, 2061 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1500 - protein, 687 aa, Artificial Sequence
  Synthetic polypeptide
EVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1501 - DNA, 651 bp, Artificial Sequence; identical to SEQ ID NO: 1413
  Synthetic polynucleotide

SEQ ID NO: 1502 - protein, 217 aa, Artificial Sequence; identical to SEQ ID NO: 1414
  Synthetic polypeptide

SEQ ID NO: 1503 - DNA, 645 bp, Artificial Sequence; identical to SEQ ID NO: 1347
  Synthetic polynucleotide

SEQ ID NO: 1504 - protein, 215 aa, Artificial Sequence; identical to SEQ ID NO: 1348
  Synthetic polypeptide

SEQ ID NO: 1505 - DNA, 2064 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1506 - protein, 688 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1507 - DNA, 633 bp, Artificial Sequence; identical to SEQ ID NO: 1437
  Synthetic polynucleotide

SEQ ID NO: 1508 - protein, 211 aa, Artificial Sequence; identical to SEQ ID NO: 1438
  Synthetic polypeptide

SEQ ID NO: 1509 - DNA, 633 bp, Artificial Sequence; identical to SEQ ID NO: 1365
  Synthetic polynucleotide

SEQ ID NO: 1510 - protein, 211 aa, Artificial Sequence; identical to SEQ ID NO: 1366
  Synthetic polypeptide

SEQ ID NO: 1511 - DNA, 2046 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1512 - protein, 682 aa, Artificial Sequence
  Synthetic polypeptide
QVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1513 - DNA, 645 bp, Artificial Sequence; identical to SEQ ID NO: 1443
  Synthetic polynucleotide

SEQ ID NO: 1514 - protein, 215 aa, Artificial Sequence; identical to SEQ ID NO: 1444
  Synthetic polypeptide

SEQ ID NO: 1515 - DNA, 633 bp, Artificial Sequence; identical to SEQ ID NO: 1365
  Synthetic polynucleotide

SEQ ID NO: 1516 - protein, 211 aa, Artificial Sequence; identical to SEQ ID NO: 1366
  Synthetic polypeptide

SEQ ID NO: 1517 - DNA, 2058 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1518 - protein, 686 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1519 - DNA, 633 bp, Artificial Sequence; identical to SEQ ID NO: 1437
  Synthetic polynucleotide

SEQ ID NO: 1520 - protein, 211 aa, Artificial Sequence; identical to SEQ ID NO: 1438
  Synthetic polypeptide

SEQ ID NO: 1521 - DNA, 633 bp, Artificial Sequence; identical to SEQ ID NO: 1377
  Synthetic polynucleotide

SEQ ID NO: 1522 - protein, 211 aa, Artificial Sequence; identical to SEQ ID NO: 1378
  Synthetic polypeptide

SEQ ID NO: 1523 - DNA, 2040 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1524 - protein, 680 aa, Artificial Sequence
  Synthetic polypeptide
QVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1525 - DNA, 645 bp, Artificial Sequence; identical to SEQ ID NO: 1443
  Synthetic polynucleotide

SEQ ID NO: 1526 - protein, 215 aa, Artificial Sequence; identical to SEQ ID NO: 1444
  Synthetic polypeptide

SEQ ID NO: 1527 - DNA, 633 bp, Artificial Sequence; identical to SEQ ID NO: 1377
  Synthetic polynucleotide

SEQ ID NO: 1528 - protein, 211 aa, Artificial Sequence; identical to SEQ ID NO: 1378
  Synthetic polypeptide

SEQ ID NO: 1529 - DNA, 2079 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1530 - protein, 693 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1531 - DNA, 633 bp, Artificial Sequence; identical to SEQ ID NO: 1437
  Synthetic polynucleotide

SEQ ID NO: 1532 - protein, 211 aa, Artificial Sequence; identical to SEQ ID NO: 1438
  Synthetic polypeptide

SEQ ID NO: 1533 - DNA, 651 bp, Artificial Sequence; identical to SEQ ID NO: 1389
  Synthetic polynucleotide

SEQ ID NO: 1534 - protein, 217 aa, Artificial Sequence; identical to SEQ ID NO: 1390
  Synthetic polypeptide

SEQ ID NO: 1535 - DNA, 2061 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1536 - protein, 687 aa, Artificial Sequence
  Synthetic polypeptide
QVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1537 - DNA, 645 bp, Artificial Sequence; identical to SEQ ID NO: 1443
  Synthetic polynucleotide

SEQ ID NO: 1538 - protein, 215 aa, Artificial Sequence; identical to SEQ ID NO: 1444
  Synthetic polypeptide

SEQ ID NO: 1539 - DNA, 651 bp, Artificial Sequence; identical to SEQ ID NO: 1389
  Synthetic polynucleotide

SEQ ID NO: 1540 - protein, 217 aa, Artificial Sequence; identical to SEQ ID NO: 1390
  Synthetic polypeptide

SEQ ID NO: 1541 - DNA, 642 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcaggaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1542 - protein, 214 aa, Artificial Sequence
  Synthetic polypeptide
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1543 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccaggagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1544 - protein, 214 aa, Artificial Sequence
  Synthetic polypeptide
EIVLTQSPGTLSLSPGERATLSCRASQSVRSSYLAWYQEKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1545 - DNA, 2046 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1546 - protein, 682 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1547 - DNA, 642 bp, Artificial Sequence; identical to SEQ ID NO: 1541
  Synthetic polynucleotide

SEQ ID NO: 1548 - protein, 214 aa, Artificial Sequence; identical to SEQ ID NO: 1542
  Synthetic polypeptide

SEQ ID NO: 1549 - DNA, 642 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcaggagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1550 - protein, 214 aa, Artificial Sequence
  Synthetic polypeptide
DIQMTQSPSSLSASVGDRVTITCRASQSINNYLNWYQERPGKAPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1551 - DNA, 2040 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1552 - protein, 680 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1553 - DNA, 642 bp, Artificial Sequence; identical to SEQ ID NO: 1541
  Synthetic polynucleotide

SEQ ID NO: 1554 - protein, 214 aa, Artificial Sequence; identical to SEQ ID NO: 1542
  Synthetic polypeptide

SEQ ID NO: 1555 - DNA, 660 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccaggagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1556 - protein, 220 aa, Artificial Sequence
  Synthetic polypeptide
DIQMTQSPSSLSASVGDRVTITCRSSQSVLYSSNNKNYLVWYQEKPGKVPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1557 - DNA, 2061 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1558 - protein, 687 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1559 - DNA, 651 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccaggagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccgagagctatctgagcctgacgcctgagcagtggaagtcccacagaagctacagctgccaggtcacgcatgaagggagcaccgtggagaagacagtggcccctacagaatgttca

SEQ ID NO: 1560 - protein, 217 aa, Artificial Sequence; identical to SEQ ID NO: 542
  Synthetic polypeptide

SEQ ID NO: 1561 - DNA, 642 bp, Artificial Sequence; identical to SEQ ID NO: 1543
  Synthetic polynucleotide

SEQ ID NO: 1562 - protein, 214 aa, Artificial Sequence; identical to SEQ ID NO: 1544
  Synthetic polypeptide

SEQ ID NO: 1563 - DNA, 2031 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1564 - protein, 677 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1565 - DNA, 651 bp, Artificial Sequence; identical to SEQ ID NO: 1559
  Synthetic polynucleotide

SEQ ID NO: 1566 - protein, 217 aa, Artificial Sequence; identical to SEQ ID NO: 542
  Synthetic polypeptide

SEQ ID NO: 1567 - DNA, 642 bp, Artificial Sequence; identical to SEQ ID NO: 1549
  Synthetic polynucleotide

SEQ ID NO: 1568 - protein, 214 aa, Artificial Sequence; identical to SEQ ID NO: 1550
  Synthetic polypeptide

SEQ ID NO: 1569 - DNA, 2025 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1570 - protein, 675 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1571 - DNA, 651 bp, Artificial Sequence; identical to SEQ ID NO: 1559
  Synthetic polynucleotide

SEQ ID NO: 1572 - protein, 217 aa, Artificial Sequence; identical to SEQ ID NO: 542
  Synthetic polypeptide

SEQ ID NO: 1573 - DNA, 660 bp, Artificial Sequence; identical to SEQ ID NO: 1555
  Synthetic polynucleotide

SEQ ID NO: 1574 - protein, 220 aa, Artificial Sequence; identical to SEQ ID NO: 1556
  Synthetic polypeptide

SEQ ID NO: 1575 - DNA, 2046 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1576 - protein, 682 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1577 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccaggagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1578 - protein, 214 aa, Artificial Sequence
  Synthetic polypeptide
EIVLTQSPGTLSLSPGERATLSCRASQSVRSSYLAWYQEKPGQAPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1579 - DNA, 642 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcaggagaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1580 - protein, 214 aa, Artificial Sequence
  Synthetic polypeptide
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1581 - DNA, 2046 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1582 - protein, 682 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1583 - DNA, 642 bp, Artificial Sequence; identical to SEQ ID NO: 1577
  Synthetic polynucleotide

SEQ ID NO: 1584 - protein, 214 aa, Artificial Sequence; identical to SEQ ID NO: 1578
  Synthetic polypeptide

SEQ ID NO: 1585 - DNA, 651 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccaggagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 1586 - protein, 217 aa, Artificial Sequence
  Synthetic polypeptide
QSVLTQPPSVSGAPGQRVTISCTGSSSNIGAGYDVHWYQEFPGTAPKLLIQGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 1587 - DNA, 2031 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1588 - protein, 677 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1589 - DNA, 642 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcaggagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1590 - protein, 214 aa, Artificial Sequence
  Synthetic polypeptide
DIQMTQSPSSLSASVGDRVTITCRASQSINNYLNWYQERPGKAPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1591 - DNA, 642 bp, Artificial Sequence; identical to SEQ ID NO: 1579
  Synthetic polynucleotide

SEQ ID NO: 1592 - protein, 214 aa, Artificial Sequence; identical to SEQ ID NO: 1580
  Synthetic polypeptide

SEQ ID NO: 1593 - DNA, 2040 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1594 - protein, 680 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1595 - DNA, 642 bp, Artificial Sequence; identical to SEQ ID NO: 1589
  Synthetic polynucleotide

SEQ ID NO: 1596 - protein, 214 aa, Artificial Sequence; identical to SEQ ID NO: 1590
  Synthetic polypeptide

SEQ ID NO: 1597 - DNA, 651 bp, Artificial Sequence; identical to SEQ ID NO: 1585
  Synthetic polynucleotide

SEQ ID NO: 1598 - protein, 217 aa, Artificial Sequence; identical to SEQ ID NO: 1586
  Synthetic polypeptide

SEQ ID NO: 1599 - DNA, 2025 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1600 - protein, 675 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1601 - DNA, 660 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccaggagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1602 - protein, 220 aa, Artificial Sequence
  Synthetic polypeptide
DIQMTQSPSSLSASVGDRVTITCRSSQSVLYSSNNKNYLVWYQEKPGKVPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1603 - DNA, 642 bp, Artificial Sequence; identical to SEQ ID NO: 1579
  Synthetic polynucleotide

SEQ ID NO: 1604 - protein, 214 aa, Artificial Sequence; identical to SEQ ID NO: 1580
  Synthetic polypeptide

SEQ ID NO: 1605 - DNA, 2061 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1606 - protein, 687 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1607 - DNA, 660 bp, Artificial Sequence; identical to SEQ ID NO: 1601
  Synthetic polynucleotide

SEQ ID NO: 1608 - protein, 220 aa, Artificial Sequence; identical to SEQ ID NO: 1602
  Synthetic polypeptide

SEQ ID NO: 1609 - DNA, 651 bp, Artificial Sequence; identical to SEQ ID NO: 1585
  Synthetic polynucleotide

SEQ ID NO: 1610 - protein, 217 aa, Artificial Sequence; identical to SEQ ID NO: 1586
  Synthetic polypeptide

SEQ ID NO: 1611 - DNA, 2046 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1612 - protein, 682 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1613 - DNA, 642 bp, Artificial Sequence; identical to SEQ ID NO: 1543
  Synthetic polynucleotide

SEQ ID NO: 1614 - protein, 214 aa, Artificial Sequence; identical to SEQ ID NO: 1544
  Synthetic polypeptide

SEQ ID NO: 1615 - DNA, 2055 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1616 - protein, 685 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1617 - DNA, 633 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcaggaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1618 - protein, 211 aa, Artificial Sequence
  Synthetic polypeptide
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1619 - DNA, 642 bp, Artificial Sequence; identical to SEQ ID NO: 1549
  Synthetic polynucleotide

SEQ ID NO: 1620 - protein, 214 aa, Artificial Sequence; identical to SEQ ID NO: 1550
  Synthetic polypeptide

SEQ ID NO: 1621 - DNA, 2049 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1622 - protein, 683 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1623 - DNA, 633 bp, Artificial Sequence; identical to SEQ ID NO: 1617
  Synthetic polynucleotide

SEQ ID NO: 1624 - protein, 211 aa, Artificial Sequence; identical to SEQ ID NO: 1618
  Synthetic polypeptide

SEQ ID NO: 1625 - DNA, 660 bp, Artificial Sequence; identical to SEQ ID NO: 1555
  Synthetic polynucleotide

SEQ ID NO: 1626 - protein, 220 aa, Artificial Sequence; identical to SEQ ID NO: 1556
  Synthetic polypeptide

SEQ ID NO: 1627 - DNA, 2070 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1628 - protein, 690 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1629 - DNA, 633 bp, Artificial Sequence; identical to SEQ ID NO: 1617
  Synthetic polynucleotide

SEQ ID NO: 1630 - protein, 211 aa, Artificial Sequence; identical to SEQ ID NO: 1618
  Synthetic polypeptide

SEQ ID NO: 1631 - DNA, 642 bp, Artificial Sequence; identical to SEQ ID NO: 1543
  Synthetic polynucleotide"=

SEQ ID NO: 1632 - protein, 214 aa, Artificial Sequence; identical to SEQ ID NO: 1544
  Synthetic polypeptide

SEQ ID NO: 1633 - DNA, 2037 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1634 - protein, 679 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1635 - DNA, 645 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccaggagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1636 - protein, 215 aa, Artificial Sequence
  Synthetic polypeptide
QSVLTQPPSVSGAPGQRVTISCTGSSSNIGAGYDVHWYQEFPGTAPKLLIQGNSNRPSGVPDRFSGSKSGTSASLAITGLQAEDEADYYCQSYDSSLSGSVFGGGTKLTVLGASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1637 - DNA, 642 bp, Artificial Sequence; identical to SEQ ID NO: 1549
  Synthetic polynucleotide

SEQ ID NO: 1638 - protein, 214 aa, Artificial Sequence; identical to SEQ ID NO: 1550
  Synthetic polypeptide

SEQ ID NO: 1639 - DNA, 2031 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1640 - protein, 677 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1641 - DNA, 645 bp, Artificial Sequence; identical to SEQ ID NO: 1635
  Synthetic polynucleotide

SEQ ID NO: 1642 - protein, 215 aa, Artificial Sequence; identical to SEQ ID NO: 1636
  Synthetic polypeptide

SEQ ID NO: 1643 - DNA, 660 bp, Artificial Sequence; identical to SEQ ID NO: 1555
  Synthetic polynucleotide

SEQ ID NO: 1644 - protein, 220 aa, Artificial Sequence; identical to SEQ ID NO: 1556
  Synthetic polypeptide

SEQ ID NO: 1645 - DNA, 2052 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1646 - protein, 684 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1647 - DNA, 645 bp, Artificial Sequence; identical to SEQ ID NO: 1635
  Synthetic polynucleotide

SEQ ID NO: 1648 - protein, 215 aa, Artificial Sequence; identical to SEQ ID NO: 1636
  Synthetic polypeptide

SEQ ID NO: 1649 - DNA, 642 bp, Artificial Sequence; identical to SEQ ID NO: 1579
  Synthetic polynucleotide

SEQ ID NO: 1650 - protein, 214 aa, Artificial Sequence; identical to SEQ ID NO: 1580
  Synthetic polypeptide

SEQ ID NO: 1651 - DNA, 2055 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1652 - protein, 685 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1653 - DNA, 633 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccaggagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1654 - protein, 211 aa, Artificial Sequence
  Synthetic polypeptide
EIVLTQSPGTLSLSPGERATLSCRASQSVRSSYLAWYQEKPGQAPRLLIYGASSRATGIPDRFSGSGSGTDFTLTISRLEPEDFAVYYCQQYGSSPTFGQGTRLEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1655 - DNA, 651 bp, Artificial Sequence; identical to SEQ ID NO: 1585
  Synthetic polynucleotide

SEQ ID NO: 1656 - protein, 217 aa, Artificial Sequence; identical to SEQ ID NO: 1586
  Synthetic polypeptide

SEQ ID NO: 1657 - DNA, 2040 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1658 - protein, 680 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1659 - DNA, 633 bp, Artificial Sequence; identical to SEQ ID NO: 1653
  Synthetic polynucleotide

SEQ ID NO: 1660 - protein, 211 aa, Artificial Sequence; identical to SEQ ID NO: 1654
  Synthetic polypeptide

SEQ ID NO: 1661 - DNA, 642 bp, Artificial Sequence; identical to SEQ ID NO: 1579
  Synthetic polynucleotide

SEQ ID NO: 1662 - protein, 214 aa, Artificial Sequence; identical to SEQ ID NO: 1580
  Synthetic polypeptide

SEQ ID NO: 1663 - DNA, 2049 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1664 - protein, 683 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1665 - DNA, 633 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcaggagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1666 - protein, 211 aa, Artificial Sequence
  Synthetic polypeptide
DIQMTQSPSSLSASVGDRVTITCRASQSINNYLNWYQERPGKAPKLLIYAASSLQSGVPSRFSGSGSGTDFTLTISSLQPEDFATYYCQQSYSTPRTFGQGTKLEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1667 - DNA, 651 bp, Artificial Sequence; identical to SEQ ID NO: 1585
  Synthetic polynucleotide

SEQ ID NO: 1668 - protein, 217 aa, Artificial Sequence; identical to SEQ ID NO: 1586
  Synthetic polypeptide

SEQ ID NO: 1669 - DNA, 2034 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1670 - protein, 678 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1671 - DNA, 633 bp, Artificial Sequence; identical to SEQ ID NO: 1665
  Synthetic polynucleotide

SEQ ID NO: 1672 - protein, 211 aa, Artificial Sequence; identical to SEQ ID NO: 1666
  Synthetic polypeptide

SEQ ID NO: 1673 - DNA, 642 bp, Artificial Sequence; identical to SEQ ID NO: 1579
  Synthetic polynucleotide

SEQ ID NO: 1674 - protein, 214 aa, Artificial Sequence; identical to SEQ ID NO: 1580
  Synthetic polypeptide

SEQ ID NO: 1675 - DNA, 2070 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1676 - protein, 690 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1677 - DNA, 651 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccaggagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1678 - protein, 217 aa, Artificial Sequence
  Synthetic polypeptide
DIQMTQSPSSLSASVGDRVTITCRSSQSVLYSSNNKNYLVWYQEKPGKVPKLLIYWASTRESGVPSRFSGSGSGTDFTLTISSLQPEDVATYYCQQYYKTPLTFGGGTKVEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1679 - DNA, 651 bp, Artificial Sequence; identical to SEQ ID NO: 1585
  Synthetic polynucleotide

SEQ ID NO: 1680 - protein, 217 aa, Artificial Sequence; identical to SEQ ID NO: 1586
  Synthetic polypeptide

SEQ ID NO: 1681 - DNA, 2055 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1682 - protein, 685 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1683 - DNA, 651 bp, Artificial Sequence; identical to SEQ ID NO: 1677
  Synthetic polynucleotide

SEQ ID NO: 1684 - protein, 217 aa, Artificial Sequence; identical to SEQ ID NO: 1678
  Synthetic polypeptide

SEQ ID NO: 1685 - DNA, 642 bp, Artificial Sequence; identical to SEQ ID NO: 1541
  Synthetic polynucleotide

SEQ ID NO: 1686 - protein, 214 aa, Artificial Sequence; identical to SEQ ID NO: 1542
  Synthetic polypeptide

SEQ ID NO: 1687 - DNA, 2055 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1688 - protein, 685 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1689 - DNA, 633 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccaggagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1690 - protein, 211 aa, Artificial Sequence
  Synthetic polypeptide
EIVLTQSPGTLSLSPGERATLSCRASQSVRSSYLAWYQEKPGQAPRLLIYGASSRATGIPDRFSGSGSGTDFTLTISRLEPEDFAVYYCQQYGSSPTFGQGTRLEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1691 - DNA, 642 bp, Artificial Sequence; identical to SEQ ID NO: 1541
  Synthetic polynucleotide

SEQ ID NO: 1692 - protein, 214 aa, Artificial Sequence; identical to SEQ ID NO: 1542
  Synthetic polypeptide

SEQ ID NO: 1693 - DNA, 2049 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1694 - protein, 683 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1695 - DNA, 633 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcaggagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1696 - protein, 211 aa, Artificial Sequence
  Synthetic polypeptide
DIQMTQSPSSLSASVGDRVTITCRASQSINNYLNWYQERPGKAPKLLIYAASSLQSGVPSRFSGSGSGTDFTLTISSLQPEDFATYYCQQSYSTPRTFGQGTKLEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1697 - DNA, 642 bp, Artificial Sequence; identical to SEQ ID NO: 1541
  Synthetic polynucleotide

SEQ ID NO: 1698 - protein, 214 aa, Artificial Sequence; identical to SEQ ID NO: 1542
  Synthetic polypeptide

SEQ ID NO: 1699 - DNA, 2070 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1700 - protein, 690 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1701 - DNA, 651 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccaggagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1702 - protein, 217 aa, Artificial Sequence
  Synthetic polypeptide
DIQMTQSPSSLSASVGDRVTITCRSSQSVLYSSNNKNYLVWYQEKPGKVPKLLIYWASTRESGVPSRFSGSGSGTDFTLTISSLQPEDVATYYCQQYYKTPLTFGGGTKVEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1703 - DNA, 651 bp, Artificial Sequence; identical to SEQ ID NO: 1559
  Synthetic polynucleotide

SEQ ID NO: 1704 - protein, 217 aa, Artificial Sequence; identical to SEQ ID NO: 542
  Synthetic polypeptide

SEQ ID NO: 1705 - DNA, 2040 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1706 - protein, 680 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1707 - DNA, 633 bp, Artificial Sequence; identical to SEQ ID NO: 1689
  Synthetic polynucleotide

SEQ ID NO: 1708 - protein, 211 aa, Artificial Sequence; identical to SEQ ID NO: 1690
  Synthetic polypeptide

SEQ ID NO: 1709 - DNA, 651 bp, Artificial Sequence; identical to SEQ ID NO: 1559
  Synthetic polynucleotide

SEQ ID NO: 1710 - protein, 217 aa, Artificial Sequence; identical to SEQ ID NO: 542
  Synthetic polypeptide

SEQ ID NO: 1711 - DNA, 2034 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1712 - protein, 678 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1713 - DNA, 633 bp, Artificial Sequence; identical to SEQ ID NO: 1695
  Synthetic polynucleotide

SEQ ID NO: 1714 - protein, 211 aa, Artificial Sequence; identical to SEQ ID NO: 1696
  Synthetic polypeptide

SEQ ID NO: 1715 - DNA, 651 bp, Artificial Sequence; identical to SEQ ID NO: 1559
  Synthetic polynucleotide

SEQ ID NO: 1716 - protein, 217 aa, Artificial Sequence; identical to SEQ ID NO: 542
  Synthetic polypeptide

SEQ ID NO: 1717 - DNA, 2055 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1718 - protein, 685 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1719 - DNA, 651 bp, Artificial Sequence; identical to SEQ ID NO: 1701
  Synthetic polynucleotide

SEQ ID NO: 1720 - protein, 217 aa, Artificial Sequence; identical to SEQ ID NO: 1702
  Synthetic polypeptide

SEQ ID NO: 1721 - DNA, 642 bp, Artificial Sequence; identical to SEQ ID NO: 1577
  Synthetic polynucleotide

SEQ ID NO: 1722 - protein, 214 aa, Artificial Sequence; identical to SEQ ID NO: 1578
  Synthetic polypeptide

SEQ ID NO: 1723 - DNA, 2055 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1724 - protein, 685 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1725 - DNA, 633 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcaggaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1726 - protein, 211 aa, Artificial Sequence
  Synthetic polypeptide
DIQMTQSPSSLSASVGDRVTITCRASQGIRNYLAWYQEKPGKAPKLLIYAASTLQSGVPSRFSGSGSGTDFTLTISSLQPEDVATYYCQRYNRAPYTFGQGTKVEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1727 - DNA, 642 bp, Artificial Sequence; identical to SEQ ID NO: 1577
  Synthetic polynucleotide

SEQ ID NO: 1728 - protein, 214 aa, Artificial Sequence; identical to SEQ ID NO: 1578
  Synthetic polypeptide

SEQ ID NO: 1729 - DNA, 2037 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1730 - protein, 679 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1731 - DNA, 645 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccaggagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1732 - protein, 215 aa, Artificial Sequence
  Synthetic polypeptide
QSVLTQPPSVSGAPGQRVTISCTGSSSNIGAGYDVHWYQEFPGTAPKLLIQGNSNRPSGVPDRFSGSKSGTSASLAITGLQAEDEADYYCQSYDSSLSGSVFGGGTKLTVLGASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1733 - DNA, 642 bp, Artificial Sequence; identical to SEQ ID NO: 1589
  Synthetic polynucleotide

SEQ ID NO: 1734 - protein, 214 aa, Artificial Sequence; identical to SEQ ID NO: 1590
  Synthetic polypeptide

SEQ ID NO: 1735 - DNA, 2049 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1736 - protein, 683 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1737 - DNA, 633 bp, Artificial Sequence; identical to SEQ ID NO: 1725
  Synthetic polynucleotide

SEQ ID NO: 1738 - protein, 211 aa, Artificial Sequence; identical to SEQ ID NO: 1726
  Synthetic polypeptide

SEQ ID NO: 1739 - DNA, 642 bp, Artificial Sequence; identical to SEQ ID NO: 1589
  Synthetic polynucleotide

SEQ ID NO: 1740 - protein, 214 aa, Artificial Sequence; identical to SEQ ID NO: 1590
  Synthetic polypeptide

SEQ ID NO: 1741 - DNA, 2031 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1742 - protein, 677 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1743 - DNA, 645 bp, Artificial Sequence; identical to SEQ ID NO: 1731
  Synthetic polynucleotide

SEQ ID NO: 1744 - protein, 215 aa, Artificial Sequence; identical to SEQ ID NO: 1732
  Synthetic polypeptide

SEQ ID NO: 1745 - DNA, 660 bp, Artificial Sequence; identical to SEQ ID NO: 1601
  Synthetic polynucleotide

SEQ ID NO: 1746 - protein, 220 aa, Artificial Sequence; identical to SEQ ID NO: 1602
  Synthetic polypeptide

SEQ ID NO: 1747 - DNA, 2070 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1748 - protein, 690 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1749 - DNA, 633 bp, Artificial Sequence; identical to SEQ ID NO: 1725
  Synthetic polynucleotide

SEQ ID NO: 1750 - protein, 211 aa, Artificial Sequence; identical to SEQ ID NO: 1726
  Synthetic polypeptide

SEQ ID NO: 1751 - DNA, 660 bp, Artificial Sequence; identical to SEQ ID NO: 1601
  Synthetic polynucleotide

SEQ ID NO: 1752 - protein, 220 aa, Artificial Sequence; identical to SEQ ID NO: 1602
  Synthetic polypeptide

SEQ ID NO: 1753 - DNA, 2052 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1754 - protein, 684 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1755 - DNA, 645 bp, Artificial Sequence; identical to SEQ ID NO: 1731
  Synthetic polynucleotide

SEQ ID NO: 1756 - protein, 215 aa, Artificial Sequence; identical to SEQ ID NO: 1732
  Synthetic polypeptide

SEQ ID NO: 1757 - DNA, 2064 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1758 - protein, 688 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1759 - DNA, 633 bp, Artificial Sequence; identical to SEQ ID NO: 1689
  Synthetic polynucleotide

SEQ ID NO: 1760 - protein, 211 aa, Artificial Sequence; identical to SEQ ID NO: 1690
  Synthetic polypeptide

SEQ ID NO: 1761 - DNA, 633 bp, Artificial Sequence; identical to SEQ ID NO: 1617
  Synthetic polynucleotide

SEQ ID NO: 1762 - protein, 211 aa, Artificial Sequence; identical to SEQ ID NO: 1618
  Synthetic polypeptide

SEQ ID NO: 1763 - DNA, 2058 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1764 - protein, 686 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1765 - DNA, 633 bp, Artificial Sequence; identical to SEQ ID NO: 1695
  Synthetic polynucleotide

SEQ ID NO: 1766 - protein, 211 aa, Artificial Sequence; identical to SEQ ID NO: 1696
  Synthetic polypeptide

SEQ ID NO: 1767 - DNA, 633 bp, Artificial Sequence; identical to SEQ ID NO: 1617
  Synthetic polynucleotide

SEQ ID NO: 1768 - protein, 211 aa, Artificial Sequence; identical to SEQ ID NO: 1618
  Synthetic polypeptide

SEQ ID NO: 1769 - DNA, 2079 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1770 - protein, 693 aa, Artificial Sequence
  Synthetic polypeptide
EVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1771 - DNA, 651 bp, Artificial Sequence; identical to SEQ ID NO: 1701
  Synthetic polynucleotide

SEQ ID NO: 1772 - protein, 217 aa, Artificial Sequence; identical to SEQ ID NO: 1702
  Synthetic polypeptide

SEQ ID NO: 1773 - DNA, 633 bp, Artificial Sequence; identical to SEQ ID NO: 1617
  Synthetic polynucleotide

SEQ ID NO: 1774 - protein, 211 aa, Artificial Sequence; identical to SEQ ID NO: 1618
  Synthetic polypeptide

SEQ ID NO: 1775 - DNA, 2046 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1776 - protein, 682 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1777 - DNA, 633 bp, Artificial Sequence; identical to SEQ ID NO: 1689
  Synthetic polynucleotide

SEQ ID NO: 1778 - protein, 211 aa, Artificial Sequence; identical to SEQ ID NO: 1690
  Synthetic polypeptide

SEQ ID NO: 1779 - DNA, 645 bp, Artificial Sequence; identical to SEQ ID NO: 1635
  Synthetic polynucleotide

SEQ ID NO: 1780 - protein, 215 aa, Artificial Sequence; identical to SEQ ID NO: 1636
  Synthetic polypeptide

SEQ ID NO: 1781 - DNA, 2040 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1782 - protein, 680 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1783 - DNA, 633 bp, Artificial Sequence; identical to SEQ ID NO: 1695
  Synthetic polynucleotide

SEQ ID NO: 1784 - protein, 211 aa, Artificial Sequence; identical to SEQ ID NO: 1696
  Synthetic polypeptide

SEQ ID NO: 1785 - DNA, 645 bp, Artificial Sequence; identical to SEQ ID NO: 1635
  Synthetic polynucleotide

SEQ ID NO: 1786 - protein, 215 aa, Artificial Sequence; identical to SEQ ID NO: 1636
  Synthetic polypeptide

SEQ ID NO: 1787 - DNA, 2061 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1788 - protein, 687 aa, Artificial Sequence
  Synthetic polypeptide
EVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1789 - DNA, 651 bp, Artificial Sequence; identical to SEQ ID NO: 1701
  Synthetic polynucleotide

SEQ ID NO: 1790 - protein, 217 aa, Artificial Sequence; identical to SEQ ID NO: 1702
  Synthetic polypeptide

SEQ ID NO: 1791 - DNA, 645 bp, Artificial Sequence; identical to SEQ ID NO: 1635
  Synthetic polynucleotide

SEQ ID NO: 1792 - protein, 215 aa, Artificial Sequence; identical to SEQ ID NO: 1636
  Synthetic polypeptide

SEQ ID NO: 1793 - DNA, 2064 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1794 - protein, 688 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1795 - DNA, 633 bp, Artificial Sequence; identical to SEQ ID NO: 1725
  Synthetic polynucleotide

SEQ ID NO: 1796 - protein, 211 aa, Artificial Sequence; identical to SEQ ID NO: 1726
  Synthetic polypeptide

SEQ ID NO: 1797 - DNA, 633 bp, Artificial Sequence; identical to SEQ ID NO: 1653
  Synthetic polynucleotide

SEQ ID NO: 1798 - protein, 211 aa, Artificial Sequence; identical to SEQ ID NO: 1654
  Synthetic polypeptide

SEQ ID NO: 1799 - DNA, 2046 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgcaagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1800 - protein, 682 aa, Artificial Sequence
  Synthetic polypeptide
QVQLQQSGAGLLKPSETLSLTCAVHGGSFSGYYWNWIRKPPGKGLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1801 - DNA, 645 bp, Artificial Sequence; identical to SEQ ID NO: 1731
  Synthetic polynucleotide

SEQ ID NO: 1802 - protein, 215 aa, Artificial Sequence; identical to SEQ ID NO: 1732
  Synthetic polypeptide

SEQ ID NO: 1803 - DNA, 633 bp, Artificial Sequence; identical to SEQ ID NO: 1653
  Synthetic polynucleotide

SEQ ID NO: 1804 - protein, 211 aa, Artificial Sequence; identical to SEQ ID NO: 1654
  Synthetic polypeptide

SEQ ID NO: 1805 - DNA, 2058 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1806 - protein, 686 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1807 - DNA, 633 bp, Artificial Sequence; identical to SEQ ID NO: 1725
  Synthetic polynucleotide

SEQ ID NO: 1808 - protein, 211 aa, Artificial Sequence; identical to SEQ ID NO: 1726
  Synthetic polypeptide

SEQ ID NO: 1809 - DNA, 633 bp, Artificial Sequence; identical to SEQ ID NO: 1665
  Synthetic polynucleotide

SEQ ID NO: 1810 - protein, 211 aa, Artificial Sequence; identical to SEQ ID NO: 1666
  Synthetic polypeptide

SEQ ID NO: 1811 - DNA, 2040 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggaagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1812 - protein, 680 aa, Artificial Sequence
  Synthetic polypeptide
QVQLQESGPGLVKPSETLSLTCTVSGGSISSYFWSWIRKPPGKGLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1813 - DNA, 645 bp, Artificial Sequence; identical to SEQ ID NO: 1731
  Synthetic polynucleotide

SEQ ID NO: 1814 - protein, 215 aa, Artificial Sequence; identical to SEQ ID NO: 1732
  Synthetic polypeptide

SEQ ID NO: 1815 - DNA, 633 bp, Artificial Sequence; identical to SEQ ID NO: 1665
  Synthetic polynucleotide

SEQ ID NO: 1816 - protein, 211 aa, Artificial Sequence; identical to SEQ ID NO: 1666
  Synthetic polypeptide

SEQ ID NO: 1817 - DNA, 2079 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggaaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1818 - protein, 693 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRKAPGKGLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1819 - DNA, 633 bp, Artificial Sequence; identical to SEQ ID NO: 1725
  Synthetic polynucleotide

SEQ ID NO: 1820 - protein, 211 aa, Artificial Sequence; identical to SEQ ID NO: 1726
  Synthetic polypeptide

SEQ ID NO: 1821 - DNA, 651 bp, Artificial Sequence; identical to SEQ ID NO: 1677
  Synthetic polynucleotide

SEQ ID NO: 1822 - protein, 217 aa, Artificial Sequence; identical to SEQ ID NO: 1678
  Synthetic polypeptide

SEQ ID NO: 1823 - DNA, 2061 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggaagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgcaagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 1824 - protein, 687 aa, Artificial Sequence
  Synthetic polypeptide
QVQLQESGPGLVKPSETLSLTCTISGDSVSTNSVAWNWIRKPPGKGLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRKMPGKGLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 1825 - DNA, 645 bp, Artificial Sequence; identical to SEQ ID NO: 1731
  Synthetic polynucleotide

SEQ ID NO: 1826 - protein, 215 aa, Artificial Sequence; identical to SEQ ID NO: 1732
  Synthetic polypeptide

SEQ ID NO: 1827 - DNA, 651 bp, Artificial Sequence; identical to SEQ ID NO: 1677
  Synthetic polynucleotide

SEQ ID NO: 1828 - protein, 217 aa, Artificial Sequence; identical to SEQ ID NO: 1678
  Synthetic polypeptide

SEQ ID NO: 1829 - DNA, 642 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggagaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1830 - protein, 214 aa, Artificial Sequence
  Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGEGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1831 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggagcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1832 - protein, 214 aa, Artificial Sequence
  Synthetic polypeptide
EIVLTQSPGTLSLSPGERATLSCRASQSVRSSYLAWYQQKPGQEPRLLIYGASSRATGIPDRFSGSGSGTDFTLTISRLEPEDFAVYYCQQYGSSPTFGQGTRLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1833 - DNA, 2046 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1834 - protein, 682 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1835 - DNA, 642 bp, Artificial Sequence; identical to SEQ ID NO: 1829
  Synthetic polynucleotide

SEQ ID NO: 1836 - protein, 214 aa, Artificial Sequence; identical to SEQ ID NO: 1830
  Synthetic polypeptide

SEQ ID NO: 1837 - DNA, 642 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagagcctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1838 - protein, 214 aa, Artificial Sequence
  Synthetic polypeptide
DIQMTQSPSSLSASVGDRVTITCRASQSINNYLNWYQQRPGKEPKLLIYAASSLQSGVPSRFSGSGSGTDFTLTISSLQPEDFATYYCQQSYSTPRTFGQGTKLEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1839 - DNA, 2040 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1840 - protein, 680 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1841 - DNA, 642 bp, Artificial Sequence; identical to SEQ ID NO: 1829
  Synthetic polynucleotide

SEQ ID NO: 1842 - protein, 214 aa, Artificial Sequence; identical to SEQ ID NO: 1830
  Synthetic polypeptide

SEQ ID NO: 1843 - DNA, 660 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggagcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1844 - protein, 220 aa, Artificial Sequence
  Synthetic polypeptide
DIQMTQSPSSLSASVGDRVTITCRSSQSVLYSSNNKNYLVWYQQKPGKEPKLLIYWASTRESGVPSRFSGSGSGTDFTLTISSLQPEDVATYYCQQYYKTPLTFGGGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1845 - DNA, 2061 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1846 - protein, 687 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1847 - DNA, 651 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcgaagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccgaaagctatctgagcctgacgcctgagcagtggaagtcccacagaagctacagctgccaggtcacgcatgaagggagcaccgtggagaagacagtggcccctacagaatgttca

SEQ ID NO: 1848 - protein, 217 aa, Artificial Sequence
  Synthetic polypeptide
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGEGTKLTVLGQPKAAPSVTLFPPSSEELQANKATLVCLISDFYPGAVTVAWKADSSPVKAGVETTTPSKQSNNKYAAESYLSLTPEQWKSHRSYSCQVTHEGSTVEKTVAPTECS

SEQ ID NO: 1849 - DNA, 642 bp, Artificial Sequence; identical to SEQ ID NO: 1831
  Synthetic polynucleotide

SEQ ID NO: 1850 - protein, 214 aa, Artificial Sequence; identical to SEQ ID NO: 1832
  Synthetic polypeptide

SEQ ID NO: 1851 - DNA, 2031 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1852 - protein, 677 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1853 - DNA, 651 bp, Artificial Sequence; identical to SEQ ID NO: 1847
  Synthetic polynucleotide

SEQ ID NO: 1854 - protein, 217 aa, Artificial Sequence; identical to SEQ ID NO: 1848
  Synthetic polypeptide

SEQ ID NO: 1855 - DNA, 642 bp, Artificial Sequence; identical to SEQ ID NO: 1837
  Synthetic polynucleotide

SEQ ID NO: 1856 - protein, 214 aa, Artificial Sequence; identical to SEQ ID NO: 1838
  Synthetic polypeptide

SEQ ID NO: 1857 - DNA, 2025 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1858 - protein, 675 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1859 - DNA, 651 bp, Artificial Sequence; identical to SEQ ID NO: 1847
  Synthetic polynucleotide

SEQ ID NO: 1860 - protein, 217 aa, Artificial Sequence; identical to SEQ ID NO: 1848
  Synthetic polypeptide

SEQ ID NO: 1861 - DNA, 660 bp, Artificial Sequence; identical to SEQ ID NO: 1843
  Synthetic polynucleotide

SEQ ID NO: 1862 - protein, 220 aa, Artificial Sequence; identical to SEQ ID NO: 1844
  Synthetic polypeptide

SEQ ID NO: 1863 - DNA, 2046 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1864 - protein, 682 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1865 - DNA, 642 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggcgaggggacacgactggagattaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1866 - protein, 214 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGEGTRLEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1867 - DNA, 642 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagagccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1868 - protein, 214 aa, Artificial Sequence
  Synthetic polypeptide
DIQMTQSPSSLSASVGDRVTITCRASQGIRNYLAWYQQKPGKEPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGEC

SEQ ID NO: 1869 - DNA, 2046 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1870 - protein, 682 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1871 - DNA, 642 bp, Artificial Sequence; identical to SEQ ID NO: 1865
  Synthetic polynucleotide

SEQ ID NO: 1872 - protein, 214 aa, Artificial Sequence; identical to SEQ ID NO: 1866
  Synthetic polypeptide

SEQ ID NO: 1873 - DNA, 651 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagagcccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccaagagctatctgagcctgacgcctgagcagtggaagtcccacagaagctacagctgccaggtcacgcatgaagggagcaccgtggagaagacagtggcccctacagaatgttca

SEQ ID NO: 1874 - protein, 217 aa, Artificial Sequence
  Synthetic polypeptide
QSVLTQPPSVSGAPGQRVTISCTGSSSNIGAGYDVHWYQQFPGTEPKLLIQGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAAKSYLSLTPEQWKSHRSYSCQVTHEGSTVEKTVAPTECS

SEQ ID NO: 1875 - DNA, 2031 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1876 - protein, 677 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1877 - DNA, 642 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggcgaggggaccaagctggaaatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1878 - protein, 214 aa, Artificial Sequence
  Synthetic polypeptide
DIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGEGTKLEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1879 - DNA, 642 bp, Artificial Sequence; identical to SEQ ID NO: 1867
  Synthetic polynucleotide

SEQ ID NO: 1880 - protein, 214 aa, Artificial Sequence; identical to SEQ ID NO: 1868
  Synthetic polypeptide

SEQ ID NO: 1881 - DNA, 2040 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1882 - protein, 680 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1883 - DNA, 642 bp, Artificial Sequence; identical to SEQ ID NO: 1877
  Synthetic polynucleotide

SEQ ID NO: 1884 - protein, 214 aa, Artificial Sequence; identical to SEQ ID NO: 1878
  Synthetic polypeptide

SEQ ID NO: 1885 - DNA, 651 bp, Artificial Sequence; identical to SEQ ID NO: 1873
  Synthetic polynucleotide

SEQ ID NO: 1886 - protein, 217 aa, Artificial Sequence; identical to SEQ ID NO: 1874
  Synthetic polypeptide

SEQ ID NO: 1887 - DNA, 2025 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1888 - protein, 675 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1889 - DNA, 660 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcgaggggaccaaggtggagatcaaacgaacggtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcgagagcaccctgacgctgagcaaagcagactacgagaaacacaaagtctacgcctgcgaagtcacccatcagggcctgagctcgcccgtcacaaagagcttcaacaggggagagtgt

SEQ ID NO: 1890 - protein, 220 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGEGTKVEIKRTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1891 - DNA, 642 bp, Artificial Sequence; identical to SEQ ID NO: 1867
  Synthetic polynucleotide

SEQ ID NO: 1892 - protein, 214 aa, Artificial Sequence; identical to SEQ ID NO: 1868
  Synthetic polypeptide

SEQ ID NO: 1893 - DNA, 2061 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1894 - protein, 687 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1895 - DNA, 660 bp, Artificial Sequence; identical to SEQ ID NO: 1889
  Synthetic polynucleotide

SEQ ID NO: 1896 - protein, 220 aa, Artificial Sequence; identical to SEQ ID NO: 1890
  Synthetic polypeptide

SEQ ID NO: 1897 - DNA, 651 bp, Artificial Sequence; identical to SEQ ID NO: 1873
  Synthetic polynucleotide

SEQ ID NO: 1898 - protein, 217 aa, Artificial Sequence; identical to SEQ ID NO: 1874
  Synthetic polypeptide

SEQ ID NO: 1899 - DNA, 2046 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1900 - protein, 682 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1901 - DNA, 642 bp, Artificial Sequence; identical to SEQ ID NO: 1831
  Synthetic polynucleotide

SEQ ID NO: 1902 - protein, 214 aa, Artificial Sequence; identical to SEQ ID NO: 1832
  Synthetic polypeptide

SEQ ID NO: 1903 - DNA, 2055 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1904 - protein, 685 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1905 - DNA, 633 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagcaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggagaagggacaaaagtcgagatcaagcgtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1906 - protein, 211 aa, Artificial Sequence
  Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGEGTKVEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1907 - DNA, 642 bp, Artificial Sequence; identical to SEQ ID NO: 1837
  Synthetic polynucleotide

SEQ ID NO: 1908 - protein, 214 aa, Artificial Sequence; identical to SEQ ID NO: 1838
  Synthetic polypeptide

SEQ ID NO: 1909 - DNA, 2049 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1910 - protein, 683 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1911 - DNA, 633 bp, Artificial Sequence; identical to SEQ ID NO: 1905
  Synthetic polynucleotide

SEQ ID NO: 1912 - protein, 211 aa, Artificial Sequence; identical to SEQ ID NO: 1906
  Synthetic polypeptide

SEQ ID NO: 1913 - DNA, 660 bp, Artificial Sequence; identical to SEQ ID NO: 1843
  Synthetic polynucleotide

SEQ ID NO: 1914 - protein, 220 aa, Artificial Sequence; identical to SEQ ID NO: 1844
  Synthetic polypeptide

SEQ ID NO: 1915 - DNA, 2070 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1916 - protein, 690 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1917 - DNA, 633 bp, Artificial Sequence; identical to SEQ ID NO: 1905
  Synthetic polynucleotide

SEQ ID NO: 1918 - protein, 211 aa, Artificial Sequence; identical to SEQ ID NO: 1906
  Synthetic polypeptide

SEQ ID NO: 1919 - DNA, 642 bp, Artificial Sequence; identical to SEQ ID NO: 1831
  Synthetic polynucleotide

SEQ ID NO: 1920 - protein, 214 aa, Artificial Sequence; identical to SEQ ID NO: 1832
  Synthetic polypeptide

SEQ ID NO: 1921 - DNA, 2037 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1922 - protein, 679 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1923 - DNA, 645 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagcccccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcgaagggaccaagctgaccgtcctaggtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1924 - protein, 215 aa, Artificial Sequence
  Synthetic polypeptide
QSVLTQPPSVSGAPGQRVTISCTGSSSNIGAGYDVHWYQQFPGTAPKLLIQGNSNRPSGVPDRFSGSKSGTSASLAITGLQAEDEADYYCQSYDSSLSGSVFGEGTKLTVLGASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1925 - DNA, 642 bp, Artificial Sequence; identical to SEQ ID NO: 1837
  Synthetic polynucleotide

SEQ ID NO: 1926 - protein, 214 aa, Artificial Sequence; identical to SEQ ID NO: 1838
  Synthetic polypeptide

SEQ ID NO: 1927 - DNA, 2031 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1928 - protein, 677 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1929 - DNA, 645 bp, Artificial Sequence; identical to SEQ ID NO: 1923
  Synthetic polynucleotide

SEQ ID NO: 1930 - protein, 215 aa, Artificial Sequence; identical to SEQ ID NO: 1924
  Synthetic polypeptide

SEQ ID NO: 1931 - DNA, 660 bp, Artificial Sequence; identical to SEQ ID NO: 1843
  Synthetic polynucleotide

SEQ ID NO: 1932 - protein, 220 aa, Artificial Sequence; identical to SEQ ID NO: 1844
  Synthetic polypeptide

SEQ ID NO: 1933 - DNA, 2052 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1934 - protein, 684 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1935 - DNA, 645 bp, Artificial Sequence; identical to SEQ ID NO: 1923
  Synthetic polynucleotide

SEQ ID NO: 1936 - protein, 215 aa, Artificial Sequence; identical to SEQ ID NO: 1924
  Synthetic polypeptide

SEQ ID NO: 1937 - DNA, 642 bp, Artificial Sequence; identical to SEQ ID NO: 1867
  Synthetic polynucleotide

SEQ ID NO: 1938 - protein, 214 aa, Artificial Sequence; identical to SEQ ID NO: 1868
  Synthetic polypeptide

SEQ ID NO: 1939 - DNA, 2055 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1940 - protein, 685 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1941 - DNA, 633 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggcgaagggacacgactggagattaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1942 - protein, 211 aa, Artificial Sequence
  Synthetic polypeptide
EIVLTQSPGTLSLSPGERATLSCRASQSVRSSYLAWYQQKPGQAPRLLIYGASSRATGIPDRFSGSGSGTDFTLTISRLEPEDFAVYYCQQYGSSPTFGEGTRLEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1943 - DNA, 651 bp, Artificial Sequence; identical to SEQ ID NO: 1873
  Synthetic polynucleotide

SEQ ID NO: 1944 - protein, 217 aa, Artificial Sequence; identical to SEQ ID NO: 1874
  Synthetic polypeptide

SEQ ID NO: 1945 - DNA, 2040 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1946 - protein, 680 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1947 - DNA, 633 bp, Artificial Sequence; identical to SEQ ID NO: 1941
  Synthetic polynucleotide

SEQ ID NO: 1948 - protein, 211 aa, Artificial Sequence; identical to SEQ ID NO: 1942
  Synthetic polypeptide

SEQ ID NO: 1949 - DNA, 642 bp, Artificial Sequence; identical to SEQ ID NO: 1867
  Synthetic polynucleotide

SEQ ID NO: 1950 - protein, 214 aa, Artificial Sequence; identical to SEQ ID NO: 1868
  Synthetic polypeptide

SEQ ID NO: 1951 - DNA, 2049 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1952 - protein, 683 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1953 - DNA, 633 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggcgaagggaccaagctggaaatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1954 - protein, 211 aa, Artificial Sequence
  Synthetic polypeptide
DIQMTQSPSSLSASVGDRVTITCRASQSINNYLNWYQQRPGKAPKLLIYAASSLQSGVPSRFSGSGSGTDFTLTISSLQPEDFATYYCQQSYSTPRTFGEGTKLEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1955 - DNA, 651 bp, Artificial Sequence; identical to SEQ ID NO: 1873
  Synthetic polynucleotide

SEQ ID NO: 1956 - protein, 217 aa, Artificial Sequence; identical to SEQ ID NO: 1874
  Synthetic polypeptide

SEQ ID NO: 1957 - DNA, 2034 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1958 - protein, 678 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1959 - DNA, 633 bp, Artificial Sequence; identical to SEQ ID NO: 1953
  Synthetic polynucleotide

SEQ ID NO: 1960 - protein, 211 aa, Artificial Sequence; identical to SEQ ID NO: 1954
  Synthetic polypeptide

SEQ ID NO: 1961 - DNA, 642 bp, Artificial Sequence; identical to SEQ ID NO: 1867
  Synthetic polynucleotide

SEQ ID NO: 1962 - protein, 214 aa, Artificial Sequence; identical to SEQ ID NO: 1868
  Synthetic polypeptide

SEQ ID NO: 1963 - DNA, 2070 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1964 - protein, 690 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1965 - DNA, 651 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggttcctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcgaagggaccaaggtggagatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgaaagcgtggtgaccgtgccctccagcagcttgggcacccagacctacatctgcaacgtgaatcacaagcccagcaacaccaaggtggacaagaaagttgagcccaaatcttgt

SEQ ID NO: 1966 - protein, 217 aa, Artificial Sequence
  Synthetic polypeptide
DIQMTQSPSSLSASVGDRVTITCRSSQSVLYSSNNKNYLVWYQQKPGKVPKLLIYWASTRESGVPSRFSGSGSGTDFTLTISSLQPEDVATYYCQQYYKTPLTFGEGTKVEIKRASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1967 - DNA, 651 bp, Artificial Sequence; identical to SEQ ID NO: 1873
  Synthetic polynucleotide"

SEQ ID NO: 1968 - protein, 217 aa, Artificial Sequence; identical to SEQ ID NO: 1874
  Synthetic polypeptide

SEQ ID NO: 1969 - DNA, 2055 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcgagagcgtggtgaccgtgccctccagcagcttgggcacccagacctacatctgcaacgtgaatcacaagcccagcaacaccaaggtggacaagaaagttgagcccaaatcttgt

SEQ ID NO: 1970 - protein, 685 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSASTKGPSVFPLAPSSKSTSGGTAALGCLVKDYFPEPVTVSWNSGALTSGVHTFPAVLQSSGLYSLESVVTVPSSSLGTQTYICNVNHKPSNTKVDKKVEPKSC

SEQ ID NO: 1971 - DNA, 651 bp, Artificial Sequence; identical to SEQ ID NO: 1965
  Synthetic polynucleotide

SEQ ID NO: 1972 - protein, 217 aa, Artificial Sequence; identical to SEQ ID NO: 1966
  Synthetic polypeptide

SEQ ID NO: 1973 - DNA, 642 bp, Artificial Sequence; identical to SEQ ID NO: 1829
  Synthetic polynucleotide

SEQ ID NO: 1974 - protein, 214 aa, Artificial Sequence; identical to SEQ ID NO: 1830
  Synthetic polypeptide

SEQ ID NO: 1975 - DNA, 2055 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1976 - protein, 685 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1977 - DNA, 633 bp, Artificial Sequence
  Synthetic polynucleotide
gaaattgtgttgacgcagtctccaggcaccctgtctttgtctccaggggaaagagccaccctctcctgcagggccagtcagagtgttagaagcagttacttagcctggtaccagcagaaacctggccaggaacccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctaccttcggccaagggacacgactggagattaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1978 - protein, 211 aa, Artificial Sequence
  Synthetic polypeptide
EIVLTQSPGTLSLSPGERATLSCRASQSVRSSYLAWYQQKPGQEPRLLIYGASSRATGIPDRFSGSGSGTDFTLTISRLEPEDFAVYYCQQYGSSPTFGQGTRLEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1979 - DNA, 642 bp, Artificial Sequence; identical to SEQ ID NO: 1829
  Synthetic polynucleotide

SEQ ID NO: 1980 - protein, 214 aa, Artificial Sequence; identical to SEQ ID NO: 1830
  Synthetic polypeptide

SEQ ID NO: 1981 - DNA, 2049 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1982 - protein, 683 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1983 - DNA, 633 bp, Artificial Sequence
  Synthetic polynucleotide
gacatccagatgacccagtctccatcctccctgtctgcatctgtaggagacagagtcaccatcacttgccgggcaagtcagagcattaacaactatttaaattggtatcagcagagaccagggaaagaacctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaagctggaaatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1984 - protein, 211 aa, Artificial Sequence
  Synthetic polypeptide
DIQMTQSPSSLSASVGDRVTITCRASQSINNYLNWYQQRPGKEPKLLIYAASSLQSGVPSRFSGSGSGTDFTLTISSLQPEDFATYYCQQSYSTPRTFGQGTKLEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1985 - DNA, 642 bp, Artificial Sequence; identical to SEQ ID NO: 1829
  Synthetic polynucleotide

SEQ ID NO: 1986 - protein, 214 aa, Artificial Sequence; identical to SEQ ID NO: 1830
  Synthetic polypeptide

SEQ ID NO: 1987 - DNA, 2070 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1988 - protein, 690 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1989 - DNA, 651 bp, Artificial Sequence
  Synthetic polynucleotide
gacatccagatgacccagtctccaagctccctgtctgcgtctgtgggcgatagggtcaccatcacttgcaggtccagccagagtgtgttatacagctccaacaataagaactacttagtttggtaccagcagaaaccaggaaaggaacctaaactgctcatttactgggcatctacccgggaatccggggtccctagtcgattcagtggcagcgggtctgggacagatttcactctcaccatcagcagcctgcagcctgaagatgtggcaacttattactgtcagcaatattataagactcctctcactttcggcggagggaccaaggtggagatcaaacgagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 1990 - protein, 217 aa, Artificial Sequence
  Synthetic polypeptide
DIQMTQSPSSLSASVGDRVTITCRSSQSVLYSSNNKNYLVWYQQKPGKEPKLLIYWASTRESGVPSRFSGSGSGTDFTLTISSLQPEDVATYYCQQYYKTPLTFGGGTKVEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 1991 - DNA, 651 bp, Artificial Sequence; identical to SEQ ID NO: 1847
  Synthetic polynucleotide

SEQ ID NO: 1992 - protein, 217 aa, Artificial Sequence; identical to SEQ ID NO: 1848
  Synthetic polypeptide

SEQ ID NO: 1993 - DNA, 2040 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 1994 - protein, 680 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 1995 - DNA, 633 bp, Artificial Sequence; identical to SEQ ID NO: 1977
  Synthetic polynucleotide

SEQ ID NO: 1996 - protein, 211 aa, Artificial Sequence; identical to SEQ ID NO: 1978
  Synthetic polypeptide

SEQ ID NO: 1997 - DNA, 651 bp, Artificial Sequence; identical to SEQ ID NO: 1847
  Synthetic polynucleotide

SEQ ID NO: 1998 - protein, 217 aa, Artificial Sequence; identical to SEQ ID NO: 1848
  Synthetic polypeptide

SEQ ID NO: 1999 - DNA, 2034 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2000 - protein, 678 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2001 - DNA, 633 bp, Artificial Sequence; identical to SEQ ID NO: 1983
  Synthetic polynucleotide

SEQ ID NO: 2002 - protein, 211 aa, Artificial Sequence; identical to SEQ ID NO: 1984
  Synthetic polypeptide

SEQ ID NO: 2003 - DNA, 651 bp, Artificial Sequence; identical to SEQ ID NO: 1847
  Synthetic polynucleotide

SEQ ID NO: 2004 - protein, 217 aa, Artificial Sequence; identical to SEQ ID NO: 1848
  Synthetic polypeptide

SEQ ID NO: 2005 - DNA, 2055 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2006 - protein, 685 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2007 - DNA, 651 bp, Artificial Sequence; identical to SEQ ID NO: 1989
  Synthetic polynucleotide

SEQ ID NO: 2008 - protein, 217 aa, Artificial Sequence; identical to SEQ ID NO: 1990
  Synthetic polypeptide

SEQ ID NO: 2009 - DNA, 642 bp, Artificial Sequence; identical to SEQ ID NO: 1865
  Synthetic polynucleotide

SEQ ID NO: 2010 - protein, 214 aa, Artificial Sequence; identical to SEQ ID NO: 1866
  Synthetic polypeptide

SEQ ID NO: 2011 - DNA, 2055 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2012 - protein, 685 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2013 - DNA, 633 bp, Artificial Sequence
  Synthetic polynucleotide
gatatccaaatgacacaatcaccatcgtcgctttcagcgtctgttggcgaccgtgtgacgattacctgtcgcgcgtcccagggaatccggaattacctcgcatggtatcagcaaaaacccggaaaagaaccgaagctcctgatctatgccgcctcgactcttcagagtggtgtgccgtcgaggtttagcgggtccgggtcaggtacggactttactctcacaatttccagcctgcagcccgaagatgtagctacctattactgccagagatacaaccgagcgccttacacattcggacaagggacaaaagtcgagatcaagcgtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 2014 - protein, 211 aa, Artificial Sequence
  Synthetic polypeptide
DIQMTQSPSSLSASVGDRVTITCRASQGIRNYLAWYQQKPGKEPKLLIYAASTLQSGVPSRFSGSGSGTDFTLTISSLQPEDVATYYCQRYNRAPYTFGQGTKVEIKRASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 2015 - DNA, 642 bp, Artificial Sequence; identical to SEQ ID NO: 1865
  Synthetic polynucleotide

SEQ ID NO: 2016 - protein, 214 aa, Artificial Sequence; identical to SEQ ID NO: 1866
  Synthetic polypeptide

SEQ ID NO: 2017 - DNA, 2037 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggatccgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 2018 - protein, 679 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 2019 - DNA, 645 bp, Artificial Sequence
  Synthetic polynucleotide
cagtctgtgctgacgcagccgccctcagtgtctggggccccagggcagagggtcaccatctcctgcactgggagcagttccaacatcggggcaggttatgatgtacactggtaccagcagtttccaggaacagaacccaaactcctcatccaaggtaacagcaatcggccctcaggggtccctgaccgattctctggctccaagtctggcacctcagcctccctggccatcactgggctccaggctgaggatgaggctgattattactgccagtcctatgacagcagcctgagtggttcggtgttcggcggagggaccaagctgaccgtcctaggtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgt

SEQ ID NO: 2020 - protein, 215 aa, Artificial Sequence
  Synthetic polypeptide
QSVLTQPPSVSGAPGQRVTISCTGSSSNIGAGYDVHWYQQFPGTEPKLLIQGNSNRPSGVPDRFSGSKSGTSASLAITGLQAEDEADYYCQSYDSSLSGSVFGGGTKLTVLGASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSC

SEQ ID NO: 2021 - DNA, 642 bp, Artificial Sequence; identical to SEQ ID NO: 1877
  Synthetic polynucleotide

SEQ ID NO: 2022 - protein, 214 aa, Artificial Sequence; identical to SEQ ID NO: 1878
  Synthetic polypeptide

SEQ ID NO: 2023 - DNA, 2049 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2024 - protein, 683 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2025 - DNA, 633 bp, Artificial Sequence; identical to SEQ ID NO: 2013
  Synthetic polynucleotide

SEQ ID NO: 2026 - protein, 211 aa, Artificial Sequence; identical to SEQ ID NO: 2014
  Synthetic polypeptide

SEQ ID NO: 2027 - DNA, 642 bp, Artificial Sequence; identical to SEQ ID NO: 1877
  Synthetic polynucleotide

SEQ ID NO: 2028 - protein, 214 aa, Artificial Sequence; identical to SEQ ID NO: 1878
  Synthetic polypeptide

SEQ ID NO: 2029 - DNA, 2031 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggatccggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 2030 - protein, 677 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 2031 - DNA, 645 bp, Artificial Sequence; identical to SEQ ID NO: 2019
  Synthetic polynucleotide

SEQ ID NO: 2032 - protein, 215 aa, Artificial Sequence; identical to SEQ ID NO: 2020
  Synthetic polypeptide

SEQ ID NO: 2033 - DNA, 660 bp, Artificial Sequence; identical to SEQ ID NO: 1889
  Synthetic polynucleotide

SEQ ID NO: 2034 - protein, 220 aa, Artificial Sequence; identical to SEQ ID NO: 1890
  Synthetic polypeptide

SEQ ID NO: 2035 - DNA, 2070 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2036 - protein, 690 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2037 - DNA, 633 bp, Artificial Sequence; identical to SEQ ID NO: 2013
  Synthetic polynucleotide

SEQ ID NO: 2038 - protein, 211 aa, Artificial Sequence; identical to SEQ ID NO: 2014
  Synthetic polypeptide

SEQ ID NO: 2039 - DNA, 660 bp, Artificial Sequence; identical to SEQ ID NO: 1889
  Synthetic polynucleotide

SEQ ID NO: 2040 - protein, 220 aa, Artificial Sequence; identical to SEQ ID NO: 1890
  Synthetic polypeptide

SEQ ID NO: 2041 - DNA, 2052 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggatcaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcaaaagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 2042 - protein, 684 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSASTKGPSVFPLAPSSKSTSGGTAALGCLVKDYFPEPVTVSWNSGALTSGVHTFPAVLQSSGLYSLKSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 2043 - DNA, 645 bp, Artificial Sequence; identical to SEQ ID NO: 2019
  Synthetic polynucleotide

SEQ ID NO: 2044 - protein, 215 aa, Artificial Sequence; identical to SEQ ID NO: 2020
  Synthetic polypeptide

SEQ ID NO: 2045 - DNA, 2064 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2046 - protein, 688 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2047 - DNA, 633 bp, Artificial Sequence; identical to SEQ ID NO: 1977
  Synthetic polynucleotide

SEQ ID NO: 2048 - protein, 211 aa, Artificial Sequence; identical to SEQ ID NO: 1978
  Synthetic polypeptide

SEQ ID NO: 2049 - DNA, 633 bp, Artificial Sequence; identical to SEQ ID NO: 1905
  Synthetic polynucleotide

SEQ ID NO: 2050 - protein, 211 aa, Artificial Sequence; identical to SEQ ID NO: 1906
  Synthetic polypeptide

SEQ ID NO: 2051 - DNA, 2058 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2052 - protein, 686 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2053 - DNA, 633 bp, Artificial Sequence; identical to SEQ ID NO: 1983
  Synthetic polynucleotide

SEQ ID NO: 2054 - protein, 211 aa, Artificial Sequence; identical to SEQ ID NO: 1984
  Synthetic polypeptide

SEQ ID NO: 2055 - DNA, 633 bp, Artificial Sequence; identical to SEQ ID NO: 1905
  Synthetic polynucleotide

SEQ ID NO: 2056 - protein, 211 aa, Artificial Sequence; identical to SEQ ID NO: 1906
  Synthetic polypeptide

SEQ ID NO: 2057 - DNA, 2079 bp, Artificial Sequence
  Synthetic polynucleotide
gaggtacaactggtggaatcaggtggaggtttggtgcagccggggagatcgctcaggcttagctgtgcggcatcggggtttactttcgatgattatgcgatgcattgggtccggcaagcgcctggaaaaaagctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtcaaggaacgttggtcaccgtctctagtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2058 - protein, 693 aa, Artificial Sequence
  Synthetic polypeptide
EVQLVESGGGLVQPGRSLRLSCAASGFTFDDYAMHWVRQAPGKKLEWVSAITWNSGHIDYADSVEGRFTISRDNAKNSLYLQMNSLRAEDTAVYYCAKVSYLSTASSLDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2059 - DNA, 651 bp, Artificial Sequence; identical to SEQ ID NO: 1989
  Synthetic polynucleotide

SEQ ID NO: 2060 - protein, 217 aa, Artificial Sequence; identical to SEQ ID NO: 1990
  Synthetic polypeptide

SEQ ID NO: 2061 - DNA, 633 bp, Artificial Sequence; identical to SEQ ID NO: 1905
  Synthetic polynucleotide

SEQ ID NO: 2062 - protein, 211 aa, Artificial Sequence; identical to SEQ ID NO: 1906
  Synthetic polypeptide

SEQ ID NO: 2063 - DNA, 2046 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagttacagcagtcgggcgcaggactgttgaagccttcggagaccctgtccctcacctgcgctgtccatggtgggtccttcagtggttactactggaactggattcgccagccaccagggaaggggctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggcaagggaaccctagtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2064 - protein, 682 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQQSGAGLLKPSETLSLTCAVHGGSFSGYYWNWIRQPPGKGLEWIGEINHAGNTNYNPSLKSRVTISLDTSKNQFSLTLTSVTAADTAVYYCARGYCRSTTCYFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2065 - DNA, 633 bp, Artificial Sequence; identical to SEQ ID NO: 1977
  Synthetic polynucleotide

SEQ ID NO: 2066 - protein, 211 aa, Artificial Sequence; identical to SEQ ID NO: 1978
  Synthetic polypeptide

SEQ ID NO: 2067 - DNA, 645 bp, Artificial Sequence; identical to SEQ ID NO: 1923
  Synthetic polynucleotide

SEQ ID NO: 2068 - protein, 215 aa, Artificial Sequence; identical to SEQ ID NO: 1924
  Synthetic polypeptide

SEQ ID NO: 2069 - DNA, 2040 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtgcagctgcaggagtcgggcccaggactggtgaagccttcggagaccctgtccctcacctgcactgtctctggtggctccatcagtagttacttctggagctggattcggcagcccccaggtaagggactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggcaagggaaccctggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2070 - protein, 680 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTVSGGSISSYFWSWIRQPPGKGLEWIGYIYYSGQTKYNPSLKSRVTISIDTSKNQFSLKLSSVTAADTAVYYCARETGSYYGFDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2071 - DNA, 633 bp, Artificial Sequence; identical to SEQ ID NO: 1983
  Synthetic polynucleotide

SEQ ID NO: 2072 - protein, 211 aa, Artificial Sequence; identical to SEQ ID NO: 1984
  Synthetic polypeptide

SEQ ID NO: 2073 - DNA, 645 bp, Artificial Sequence; identical to SEQ ID NO: 1923
  Synthetic polynucleotide

SEQ ID NO: 2074 - protein, 215 aa, Artificial Sequence; identical to SEQ ID NO: 1924
  Synthetic polypeptide

SEQ ID NO: 2075 - DNA, 2061 bp, Artificial Sequence
  Synthetic polynucleotide
gaggtgcagctggtgcagtctggagcagaggtgaaaaagcccggggagtctctgaagatctcctgtaagacttctgaatacagctttaccagctactggatcggctgggtgcgccagatgcccgggaaaaaactggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggccagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccaagagctacctgagcctgacgcccgagcagtggaagtcccacagaagctacagctgccaggtcacgcatgaagggagcaccgtggagaagacagtggcccctacagaatgttcagacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatcccaggtacagttgcaggagtcaggtccaggactggtgaagccctcggagaccctctcactcacctgtaccatctccggggacagtgtctctaccaacagtgttgcttggaactggattaggcagcccccagggaaaggccttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggcaaagggaccacggtcaccgtctcctcaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2076 - protein, 687 aa, Artificial Sequence
  Synthetic polypeptide
EVQLVQSGAEVKKPGESLKISCKTSEYSFTSYWIGWVRQMPGKKLEWMGIIYLGDSDTRYSPSFQGQVTISADKSISTAYLQWSSLKASDTAMYYCARSNWGLDYWGQGTLVTVSSQPKANPTVTLFPPSSEELQANKATLVCLISDFYPGAVTVAWKADGSPVKAGVETTKPSKQSNNKYAAKSYLSLTPEQWKSHRSYSCQVTHEGSTVEKTVAPTECSDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSQVQLQESGPGLVKPSETLSLTCTISGDSVSTNSVAWNWIRQPPGKGLEWIGRTYYRSKWYNDYAVSLKSRVTISPDTSKNQFSLKLSSVTAADTAVYYCAREDGDSYYRYGMDVWGKGTTVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2077 - DNA, 651 bp, Artificial Sequence; identical to SEQ ID NO: 1989
  Synthetic polynucleotide

SEQ ID NO: 2078 - protein, 217 aa, Artificial Sequence; identical to SEQ ID NO: 1990
  Synthetic polypeptide

SEQ ID NO: 2079 - DNA, 645 bp, Artificial Sequence; identical to SEQ ID NO: 1923
  Synthetic polynucleotide

SEQ ID NO: 2080 - protein, 215 aa, Artificial Sequence; identical to SEQ ID NO: 1924
  Synthetic polypeptide

SEQ ID NO: 2081 - DNA, 2064 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2082 - protein, 688 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2083 - DNA, 633 bp, Artificial Sequence; identical to SEQ ID NO: 2013
  Synthetic polynucleotide

SEQ ID NO: 2084 - protein, 211 aa, Artificial Sequence; identical to SEQ ID NO: 2014
  Synthetic polypeptide

SEQ ID NO: 2085 - DNA, 633 bp, Artificial Sequence; identical to SEQ ID NO: 1941
  Synthetic polynucleotide

SEQ ID NO: 2086 - protein, 211 aa, Artificial Sequence; identical to SEQ ID NO: 1942
  Synthetic polypeptide

SEQ ID NO: 2087 - DNA, 2046 bp, Artificial Sequence
  Synthetic polynucleotide
caggtgcagttacagcagtcgggcgcaggactgttgaagccttcggagaccctgtccctcacctgcgctgtccatggtgggtccttcagtggttactactggaactggattcgccagccaccagggaagaagctagagtggattggggaaatcaatcatgctggaaacaccaactacaacccgtccctcaagagtcgagtcaccatatcattagacacgtccaagaaccagttctccctgacgctgacctctgtgaccgccgcggacacggctgtgtattactgtgcgagaggatattgtagaagtaccacctgctactttgactactggggccagggaaccctagtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 2088 - protein, 682 aa, Artificial Sequence
  Synthetic polypeptide
QVQLQQSGAGLLKPSETLSLTCAVHGGSFSGYYWNWIRQPPGKKLEWIGEINHAGNTNYNPSLKSRVTISLDTSKNQFSLTLTSVTAADTAVYYCARGYCRSTTCYFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 2089 - DNA, 645 bp, Artificial Sequence; identical to SEQ ID NO: 2019
  Synthetic polynucleotide

SEQ ID NO: 2090 - protein, 215 aa, Artificial Sequence; identical to SEQ ID NO: 2020
  Synthetic polypeptide

SEQ ID NO: 2091 - DNA, 633 bp, Artificial Sequence; identical to SEQ ID NO: 1941
  Synthetic polynucleotide

SEQ ID NO: 2092 - protein, 211 aa, Artificial Sequence; identical to SEQ ID NO: 1942
  Synthetic polypeptide

SEQ ID NO: 2093 - DNA, 2058 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2094 - protein, 686 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2095 - DNA, 633 bp, Artificial Sequence; identical to SEQ ID NO: 2013
  Synthetic polynucleotide

SEQ ID NO: 2096 - protein, 211 aa, Artificial Sequence; identical to SEQ ID NO: 2014
  Synthetic polypeptide

SEQ ID NO: 2097 - DNA, 633 bp, Artificial Sequence; identical to SEQ ID NO: 1953
  Synthetic polynucleotide

SEQ ID NO: 2098 - protein, 211 aa, Artificial Sequence; identical to SEQ ID NO: 1954
  Synthetic polypeptide

SEQ ID NO: 2099 - DNA, 2040 bp, Artificial Sequence
  Synthetic polynucleotide
caggtgcagctgcaggagtcgggcccaggactggtgaagccttcggagaccctgtccctcacctgcactgtctctggtggctccatcagtagttacttctggagctggattcggcagcccccaggtaagaaactggagtggattggctatatctattacagtgggcagaccaaatacaacccctccctcaagagtcgagtcaccatatcaatagacacgtccaagaaccagttctccctgaagctgagctctgtgaccgctgcggacacggccgtgtattactgtgcgagagaaactgggagctactacggctttgactactggggccagggaaccctggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 2100 - protein, 680 aa, Artificial Sequence
  Synthetic polypeptide
QVQLQESGPGLVKPSETLSLTCTVSGGSISSYFWSWIRQPPGKKLEWIGYIYYSGQTKYNPSLKSRVTISIDTSKNQFSLKLSSVTAADTAVYYCARETGSYYGFDYWGQGTLVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 2101 - DNA, 645 bp, Artificial Sequence; identical to SEQ ID NO: 2019
  Synthetic polynucleotide

SEQ ID NO: 2102 - protein, 215 aa, Artificial Sequence; identical to SEQ ID NO: 2020
  Synthetic polypeptide

SEQ ID NO: 2103 - DNA, 633 bp, Artificial Sequence; identical to SEQ ID NO: 1953
  Synthetic polynucleotide

SEQ ID NO: 2104 - protein, 211 aa, Artificial Sequence; identical to SEQ ID NO: 1954
  Synthetic polypeptide

SEQ ID NO: 2105 - DNA, 2079 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtacaactggtggaatcaggtggaggtttggtgcagccggggagatcgctcaggcttagctgtgcggcatcggggtttactttcgatgattatgcgatgcattgggtccggcaagcgcctggaaaagggctcgagtgggtttccgccattacgtggaatagcggacacatcgattatgcagacagtgtggagggcagattcacaatctcacgagacaatgctaagaacagcctgtaccttcagatgaactcacttcgcgcggaagataccgccgtatactactgcgccaaagtctcctacttgtctacagcttcgtcgctcgactattggggtaaaggaacgttggtcaccgtctctagtactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcgaaagcaccctgacgctgagcaaagcagactacgagaaacacaaagtctacgcctgcgaagtcacccatcagggcctgagctcgcccgtcacaaagagcttcaacaggggagagtgt

SEQ ID NO: 2106 - protein, 693 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGKGTLVTVSSTVAAPSVFIFPPSDEQLKSGTASVVCLLNNFYPREAKVQWKVDNALQSGNSQESVTEQDSKDSTYSLESTLTLSKADYEKHKVYACEVTHQGLSSPVTKSFNRGEC

SEQ ID NO: 2107 - DNA, 633 bp, Artificial Sequence; identical to SEQ ID NO: 2013
  Synthetic polynucleotide

SEQ ID NO: 2108 - protein, 211 aa, Artificial Sequence; identical to SEQ ID NO: 2014
  Synthetic polypeptide

SEQ ID NO: 2109 - DNA, 651 bp, Artificial Sequence; identical to SEQ ID NO: 1965
  Synthetic polynucleotide

SEQ ID NO: 2110 - protein, 217 aa, Artificial Sequence; identical to SEQ ID NO: 1966
  Synthetic polypeptide

SEQ ID NO: 2111 - DNA, 2061 bp, Artificial Sequence
  Synthetic polynucleotide
caggtacagttgcaggagtcaggtccaggactggtgaagccctcggagaccctctcactcacctgtaccatctccggggacagtgtctctaccaacagtgttgcttggaactggattaggcagcccccagggaaaaaacttgagtggataggaaggacatactacaggtccaagtggtataatgattatgcagtttctctgaaaagtcgagtaaccatcagcccagacacatccaagaaccagttctccctgaagctgagctctgtgactgccgcggacacggctgtgtattactgtgcaagagaggatggggatagctactaccgctacggtatggacgtctggggccaagggaccacggtcaccgtctcctcaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcaagagcaccctgacgctgagcaaagcagactacgagaaacacaaagtctacgcctgcgaagtcacccatcagggcctgagctcgcccgtcacaaagagcttcaacaggggagagtgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgtgaggagcagtacggcagcacgtaccgttgtgtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtggtggcggatcgggaggtggcggatccgaggtgcagctggtgcagtctggagcagaggtgaaaaagcccggggagtctctgaagatctcctgtaagacttctgaatacagctttaccagctactggatcggctgggtgcgccagatgcccgggaaaggcctggagtggatggggatcatctatcttggtgactcagataccagatacagcccgtccttccaaggccaggtcaccatctcagccgacaagtccatcagtaccgcctacctgcagtggagcagcctgaaggcctcggacaccgccatgtattactgtgcgagaagtaactggggtcttgactactggggcaagggaaccctggtcaccgtctctagtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccgagagctacctgagcctgacgcccgagcagtggaagtcccacagaagctacagctgccaggtcacgcatgaagggagcaccgtggagaagacagtggcccctacagaatgttca

SEQ ID NO: 2112 - protein, 687 aa, Artificial Sequence
  Synthetic polypeptide
QVQLQESGPGLVKPSETLSLTCTISGDSVSTNSVAWNWIRQPPGKKLEWIGRTYYRSKWYNDYAVSLKSRVTISPDTSKNQFSLKLSSVTAADTAVYYCAREDGDSYYRYGMDVWGQGTTVTVSSTVAAPSVFIFPPSDEQLKSGTASVVCLLNNFYPREAKVQWKVDNALQSGNSQESVTEQDSKDSTYSLKSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGSGGGGSEVQLVQSGAEVKKPGESLKISCKTSEYSFTSYWIGWVRQMPGKGLEWMGIIYLGDSDTRYSPSFQGQVTISADKSISTAYLQWSSLKASDTAMYYCARSNWGLDYWGKGTLVTVSSQPKANPTVTLFPPSSEELQANKATLVCLISDFYPGAVTVAWKADGSPVKAGVETTKPSKQSNNKYAAESYLSLTPEQWKSHRSYSCQVTHEGSTVEKTVAPTECS

SEQ ID NO: 2113 - DNA, 645 bp, Artificial Sequence; identical to SEQ ID NO: 2019
  Synthetic polynucleotide

SEQ ID NO: 2114 - protein, 215 aa, Artificial Sequence; identical to SEQ ID NO: 2020
  Synthetic polypeptide

SEQ ID NO: 2115 - DNA, 651 bp, Artificial Sequence; identical to SEQ ID NO: 1965
  Synthetic polynucleotide

SEQ ID NO: 2116 - protein, 217 aa, Artificial Sequence; identical to SEQ ID NO: 1966
  Synthetic polypeptide

SEQ ID NO: 2117 - DNA, 21 bp, Artificial Sequence
  Synthetic oligonucleotide
gctgcatccagtttgcaaagt

SEQ ID NO: 2118 - DNA, 27 bp, Artificial Sequence
  Synthetic oligonucleotide
caacagagttacagtacccctcggacg

SEQ ID NO: 2119 - DNA, 51 bp, Artificial Sequence; identical to SEQ ID NO: 127
  Synthetic oligonucleotide

SEQ ID NO: 2120 - DNA, 21 bp, Artificial Sequence
  Synthetic oligonucleotide
tgggcatctacccgggaatcc

SEQ ID NO: 2121 - DNA, 27 bp, Artificial Sequence
  Synthetic oligonucleotide
cagcaatattataagactcctctcact

SEQ ID NO: 2122 - DNA, 15 bp, Artificial Sequence
  Synthetic oligonucleotide
gattatgcgatgcat

SEQ ID NO: 2123 - DNA, 51 bp, Artificial Sequence; identical to SEQ ID NO: 159
  Synthetic oligonucleotide

SEQ ID NO: 2124 - DNA, 36 bp, Artificial Sequence; identical to SEQ ID NO: 161
  Synthetic oligonucleotide

SEQ ID NO: 2125 - DNA, 15 bp, Artificial Sequence
  Synthetic oligonucleotide
agctactggatcggc

SEQ ID NO: 2126 - DNA, 51 bp, Artificial Sequence; identical to SEQ ID NO: 213
  Synthetic oligonucleotide

SEQ ID NO: 2127 - DNA, 21 bp, Artificial Sequence
  Synthetic oligonucleotide
agtaactggggtcttgactac

SEQ ID NO: 2128 - DNA, 15 bp, Artificial Sequence
  Synthetic oligonucleotide
ggttactactggaac

SEQ ID NO: 2129 - DNA, 48 bp, Artificial Sequence; identical to SEQ ID NO: 189
  Synthetic oligonucleotide

SEQ ID NO: 2130 - DNA, 36 bp, Artificial Sequence; identical to SEQ ID NO: 191
  Synthetic oligonucleotide

SEQ ID NO: 2131 - DNA, 15 bp, Artificial Sequence
  Synthetic oligonucleotide
agttacttctggagc

SEQ ID NO: 2132 - DNA, 48 bp, Artificial Sequence
  Synthetic oligonucleotide
tatatctattacagtgggcagaccaaatacaacccctccctcaagagt

SEQ ID NO: 2133 - DNA, 30 bp, Artificial Sequence; identical to SEQ ID NO: 179
  Synthetic oligonucleotide

SEQ ID NO: 2134 - DNA, 21 bp, Artificial Sequence
  Synthetic oligonucleotide
accaacagtgttgcttggaac

SEQ ID NO: 2135 - DNA, 54 bp, Artificial Sequence; identical to SEQ ID NO: 195
  Synthetic oligonucleotide

SEQ ID NO: 2136 - DNA, 39 bp, Artificial Sequence; identical to SEQ ID NO: 185
  Synthetic oligonucleotide

What is claimed is:

1. An antigen binding protein comprising a TL1A binding entity and a TNF-α binding entity, wherein:
   a. the TL1A binding entity has one or two TL1A binding heavy chain variable domains comprising anti-TL1A HCDR1, anti-TL1A HCDR2, and anti-TL1A HCDR3, wherein:
      i. anti-TL1A HCDR1 comprises a sequence of SEQ ID NO: 188;
      ii. anti-TL1A HCDR2 comprises a sequence of SEQ ID NO: 190;
      iii. anti-TL1A HCDR3 comprises a sequence of SEQ ID NO: 192;
   b. the TL1A binding entity has one or two TL1A binding light chain variable domains comprising anti-TL1A LCDR1, anti-TL1A LCDR2, and anti-TL1A LCDR3, wherein:
      i. anti-TL1A LCDR1 comprises a sequence of SEQ ID NO: 122;
      ii. anti-TL1A LCDR2 comprises a sequence of SEQ ID NO: 124;
      iii. anti-TL1A LCDR3 comprises a sequence selected from SEQ ID NO: 126;
   c. the TNF-α binding entity comprises one or two TNF-α binding heavy chain variable domains comprising anti-TNF HCDR1, anti-TNF HCDR2, and anti-TNF HCDR3, wherein:
      i. anti-TNF HCDR1 comprises a sequence selected from SEQ ID NOS: 158, 218, 206, and 212;
      ii. anti-TNF HCDR2 comprises a sequence selected from SEQ ID NOS: 160, 220, 208, and 214;
      iii. anti-TNF HCDR3 comprises a sequence selected from SEQ ID NOS: 162, 222, 210, and 216; and
   d. the TNF-α binding entity comprises one or two TNF-α binding light chain variable domains comprising an anti-TNF LCDR1, anti-TNF LCDR2, and anti-TNF LCDR3, wherein;
      i. anti-TNF LCDR1 comprises a sequence selected from SEQ ID NOS:92, 152, 140, and 146,
      ii. anti-TNF LCDR2 comprises a sequence selected from SEQ ID NOS: 94, 154, 112, and 148, and
      iii. anti-TNF LCDR3 comprises a sequence selected from SEQ ID NOS: 96, 156, 144, and 150.

2. The antigen binding protein of claim 1 wherein the TL1A binding heavy chain variable domain comprises a sequence at least about 90% identical to SEQ ID NO: 24.

3. The antigen binding protein of claim 1, wherein the TL1A binding light chain variable domain comprises a sequence at least about 90% identical to SEQ ID NO: 22.

4. The antigen binding protein of claim 1, wherein the TL1A binding entity comprises a heavy chain that comprises a sequence at least about 90% identical to SEQ ID NO: 68.

5. The antigen binding protein of claim 1, wherein the TL1A binding entity comprises a light chain that comprises a sequence at least about 90% identical to SEQ ID NO: 66.

6. The antigen binding protein of claim 1 comprising light and heavy chain sequences of SEQ ID NOS: 66 and 68.

7. The antigen binding protein of claim 1 wherein:
   a. the TNF-α binding entity comprises one or two TNF-α binding heavy chain variable domains comprising anti-TNF HCDR1, anti-TNF HCDR2, and anti-TNF HCDR3, wherein:
      i. anti-TNF HCDR1 comprises a sequence of SEQ ID NO: 218,
      ii. anti-TNF HCDR2 comprises a sequence of SEQ ID NO: 220, and
      iii. anti-TNF HCDR3 comprises a sequence of SEQ ID NO: 222; and
   b. the TNF-α binding entity comprises one or two TNF-α binding light chain variable domains comprising an anti-TNF LCDR1, anti-TNF LCDR2, and anti-TNF LCDR3, wherein:
      i. anti-TNF LCDR1 comprises a sequence of SEQ ID NO: 152,
      ii. anti-TNF LCDR2 comprises a sequence of SEQ ID NO: 154, and
      iii. anti-TNF LCDR3 comprises a sequence of SEQ ID NO: 156.

8. The antigen binding protein of claim 1, wherein the TNF-α binding heavy chain variable domain comprises a sequence at least about 90% identical to a sequence selected from SEQ ID NOS: 4, 44, 286, 318, 40, and 36.

9. The antigen binding protein of claim 1, wherein the TNF-α binding heavy chain variable domain comprises a sequence at least about 90% identical to a sequence selected from SEQ ID NOS: 44, 286, and 318.

10. The antigen binding protein of claim 1, wherein the TNF-α binding light chain variable domain comprises a sequence at least about 90% identical to a sequence selected from SEQ ID NOS: 2, 42, 38, and 34.

11. The antigen binding protein of claim 1, wherein the TNF-α binding light chain variable domain comprises a sequence at least about 90% identical to a sequence of SEQ ID NO: 42.

12. The antigen binding protein of claim 1 comprising a set of variable domain sequences selected from SEQ ID NOS:
   a. 42, 286, 288, and 290;
   b. 312, 314, 288, and 290;
   c. 42, 318, 288, and 290; and
   d. 320, 322, 288, and 290.

13. The antigen binding protein of claim 1 comprising a set of variable domain sequences selected from SEQ ID NOS:
   a. 42, 286, 288, and 290; and
   b. 42, 318, 288, and 290.

14. The antigen binding protein of claim 1, wherein the heavy and light chains are human IgG1, IgG2, or IgG4 and wherein:
   a. the TL1A binding entity comprises two TL1A binding heavy chains and two TL1A binding light chains, wherein:
      i. each TL1A binding heavy chain comprises a TL1A binding heavy chain variable domain; and
      ii. each TL1A binding light chain comprises a TL1A binding light chain variable domain; and
   b. the TNF-α entity comprises two TNF-α binding heavy chains and two TNF-α binding light chains, wherein:
      i. each TNF-α binding heavy chain comprises a TL1A binding heavy chain variable domain; and
      ii. each TNF-α binding light chain comprises a TL1A binding light chain variable domain.

15. The antigen binding protein of claim 14 comprising a set of sequences selected from SEQ ID NOS:
   132, 136, 134, and 130;
   132, 316, 134, and 130;
   333, 316, 134, and 130;
   333, 463, 134, and 130;
   341, 343, 134, and 130;
   510, 514, 512, and 555;
   510, 514, 541, and 558;
   510, 573, 512, and 555;
   542, 571, 512, and 555;
   540, 573, 512, and 555;
   540, 487, 512, and 555;
   518, 522, 512, and 555;
   545, 578, 546, and 579;
   547, 595, 546, and 579;
   132, 599, 134, and 598;
   337, 609, 134, and 598;
   132, 611, 134, and 598;
   333, 611, 134, and 598;
   333, 613, 134, and 598;
   510, 487, 512, and 555;
   132, 613, 134, and 598;
   132, 463, 134, and 130;
   540, 616, 512, and 508;
   540, 620, 512, and 508;
   538, 623, 512, and 502;
   537, 626, 512, and 508;
   546, 514, 194, and 535;
   536, 616, 194, and 535;
   536, 620, 194, and 535;
   546, 487, 194, and 535;
   471, 136, 473, and 198;
   479, 477, 473, and 198;
   176, 136, 520, and 198;
   475, 477, 520, and 198;
   471, 463, 473, and 198;
   176, 463, 473, and 198;
   471, 465, 473, and 198;
   176, 463, 570, and 198;
   471, 465, 473, and 198;
   176, 465, 520, and 198;
   510, 514, 512, and 508;
   518, 522, 512, and 508; and
   540, 616, 512, and 508.

16. The antigen binding protein of claim 14 comprising a set of sequences selected from SEQ ID NOS:
   132, 136, 134, and 130;
   132, 316, 134, and 130;
   333, 316, 134, and 130;
   333, 463, 134, and 130;
   510, 514, 512, and 555;
   510, 514, 541, and 558;
   510, 573, 512, and 555;
   540, 573, 512, and 555;
   540, 487, 512, and 555;
   545, 578, 546, and 579;
   132, 599, 134, and 598;
   132, 611, 134, and 598;
   333, 611, 134, and 598;
   333, 613, 134, and 598;
   510, 487, 512, and 555;
   132, 613, 134, and 598;
   132, 463, 134, and 130;
   540, 616, 512, and 508;
   540, 620, 512, and 508;
   546, 514, 194, and 535;
   536, 616, 194, and 535;
   536, 620, 194, and 535;
   546, 487, 194, and 535;
   471, 136, 473, and 198;
   479, 477, 473, and 198;
   176, 136, 520, and 198;
   475, 477, 520, and 198;
   471, 463, 473, and 198;
   176, 463, 473, and 198;
   471, 465, 473, and 198;
   176, 463, 570, and 198;
   471, 465, 473, and 198;
   176, 465, 520, and 198; and
   510, 514, 512, and 508.

17. The antigen binding protein of claim 14 comprising the sequences of iPS No. 376543 (SEQ ID NOS: 510, 516, 512, and 508).

18. The antigen binding protein of claim 14, wherein:
   a. one heavy chain comprises substitutions K392D and K409D and the other heavy chain comprises substitutions E356K and D399K using EU numbering; or
   b. one heavy chain comprises substitutions K392D, K409D and K370D and the other heavy chain comprises substitutions E356K, D399K and E357K using EU numbering.

19. The antigen binding protein of claim 14, wherein:
   a. one heavy chain comprises substitution S183K, the other heavy chain comprises substitution S183E, one light chain comprises substitution S176E, and the other light chain comprises substitution S176K using EU numbering; or
   b. one heavy chain comprises substitutions Q39K and S183K, the other heavy chain comprises substitutions Q39E and S183E, one light chain comprises substitutions Q38E and S176E, and the other light chain comprises substitutions Q38K and S176K using EU numbering; or
   c. one heavy chain comprises substitutions G44K and S183K, the other heavy chain comprises substitutions G44E and S183E, one light chain comprises substitutions G100E and S176E, and the other light chain comprises substitutions G100K and S176K using EU numbering; or
   d. one heavy chain comprises substitution S183K, the other heavy chain comprises substitution 5183E, one light chain comprises substitution S176E, and the other light chain comprises substitution S176K using EU numbering.

20. The antigen binding protein of claim 14, wherein the antigen binding protein comprises two IgG1 heavy chains comprising substitutions R292C, V302C and N297G using EU numbering.

* * * * *